(12) United States Patent
Yelin et al.

(10) Patent No.: US 8,962,915 B2
(45) Date of Patent: *Feb. 24, 2015

(54) ISOLATED POLYPEPTIDES, POLYNUCLEOTIDES ENCODING SAME, TRANSGENIC PLANTS EXPRESSING SAME AND METHODS OF USING SAME

(75) Inventors: Rodrigo Yelin, Zur-Yigal (IL); Avi Shoshan, Kfar Shmuel (IL); Evgenia Gold, Rechovot (IL); Sharon Ayal, Kiryat-Ekron (IL); Hagai Karchi, Moshav Sitriya (IL)

(73) Assignee: Evogene Ltd., Rechovot (IL)

( * ) Notice: Subject to any disclaimer, the term of this patent is extended or adjusted under 35 U.S.C. 154(b) by 432 days.

This patent is subject to a terminal disclaimer.

(21) Appl. No.: 12/083,978

(22) PCT Filed: Oct. 24, 2006

(86) PCT No.: PCT/IL2006/001223
§ 371 (c)(1),
(2), (4) Date: Apr. 23, 2008

(87) PCT Pub. No.: WO2007/049275
PCT Pub. Date: May 3, 2007

(65) Prior Publication Data
US 2009/0293154 A1    Nov. 26, 2009

Related U.S. Application Data

(63) Continuation-in-part of application No. 11/626,411, filed as application No. PCT/IL2005/000627 on Jun. 14, 2005, now Pat. No. 7,812,218.

(60) Provisional application No. 60/578,833, filed on Jun. 14, 2004, provisional application No. 60/729,181, filed on Oct. 24, 2005.

(51) Int. Cl.
*C12N 15/82* (2006.01)
*C07K 14/415* (2006.01)

(52) U.S. Cl.
CPC .......... *C12N 15/8261* (2013.01); *C07K 14/415* (2013.01); *C12N 15/8271* (2013.01); *C12N 15/8273* (2013.01)
USPC ...................................................... 800/278

(58) Field of Classification Search
USPC .................. 435/6, 69.1, 468, 419, 320.1, 6.1; 530/370; 536/23.6; 800/278, 295
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Wang et al., Plant Cell, vol. 16, Sep. 2004, pp. 2323-2334.*
Wang et al., GenEmbl Database, Acc. No. AY641990, Plant Cell, vol. 16, Sep. 2004, pp. 2323-2334.*
Li et al, Isolation of genes preferentially expressed in cotton fibers by cDNA filter arrays and RT-PCR, Plant Sci. (2002) 163:1113-1120.*
Wang et al, Control of plant trichome development by a cotton fiber MYB gene, Plant Cell (2004) 16:2323-2334.*
International Preliminary Report on Patentability Dated Jan. 22, 2009 From the International Bureau of WIPO Re.: Application No. PCT/IL2006/001223.

(Continued)

*Primary Examiner* — David H Kruse
*Assistant Examiner* — Mykola Kovalenko

(57) ABSTRACT

Nucleic acid constructs are provided. These constructs comprise any of the, nucleic acid sequences at least 85% identical to nucleotide sequences selected from the group consisting of SEQ ID NOs: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108 and 109 and a promoter sequence capable of directing transcription of said nucleic acid sequence in a host cell. Also provided are transgenic plants expressing these nucleic acid constructs and methods of using same.

11 Claims, 19 Drawing Sheets
(17 of 19 Drawing Sheet(s) Filed in Color)

(56) References Cited

U.S. PATENT DOCUMENTS

| | | | |
|---|---|---|---|
| 5,495,070 A | 2/1996 | John | |
| 5,504,200 A | 4/1996 | Hall et al. | |
| 5,521,708 A | 5/1996 | Beretta | |
| 5,569,597 A | 10/1996 | Grimsley et al. | |
| 5,597,718 A | 1/1997 | John et al. | |
| 5,604,121 A | 2/1997 | Hilder et al. | |
| 5,608,142 A | 3/1997 | Barton et al. | |
| 5,608,144 A | 3/1997 | Baden et al. | |
| 5,608,149 A | 3/1997 | Barry et al. | |
| 5,608,152 A | 3/1997 | Kridl et al. | |
| 5,620,882 A | 4/1997 | John | |
| 5,659,026 A | 8/1997 | Baszczynski et al. | |
| 5,693,507 A | 12/1997 | Daniell et al. | |
| 5,859,330 A | 1/1999 | Bestwick et al. | |
| 5,880,100 A | 3/1999 | Ogiso et al. | |
| 5,961,466 A | 10/1999 | Anbar | |
| 5,981,834 A | 11/1999 | John et al. | |
| 6,080,914 A | 6/2000 | Conner | |
| 6,084,153 A | 7/2000 | Good et al. | |
| 6,094,198 A | 7/2000 | Shashua | |
| 6,167,151 A | 12/2000 | Albeck et al. | |
| 6,201,541 B1 | 3/2001 | Shalom et al. | |
| 6,313,375 B1 | 11/2001 | Jung et al. | |
| 6,313,376 B1 | 11/2001 | Jung et al. | |
| 6,359,196 B1 | 3/2002 | Lok et al. | |
| 6,392,122 B1 | 5/2002 | Clendennen et al. | |
| 6,403,862 B1 | 6/2002 | Jiao et al. | |
| 6,442,419 B1 | 8/2002 | Chu et al. | |
| 6,472,588 B1 | 10/2002 | Haigler et al. | |
| 6,670,528 B1 | 12/2003 | Shinozaki et al. | |
| 6,701,081 B1 | 3/2004 | Dwyer et al. | |
| 6,720,477 B2 | 4/2004 | Da Costa e Silva et al. | |
| 6,765,607 B2 | 7/2004 | Mizusawa et al. | |
| 6,801,257 B2 | 10/2004 | Segev et al. | |
| 6,850,862 B1 | 2/2005 | Chidichimo et al. | |
| 6,965,690 B2 | 11/2005 | Matsumoto | |
| 7,072,504 B2 | 7/2006 | Miyano et al. | |
| 7,214,786 B2 | 5/2007 | Kovalic et al. | |
| 7,292,719 B2 | 11/2007 | Arnon | |
| 7,554,007 B2 | 6/2009 | Ronen et al. | |
| 7,812,218 B2 | 10/2010 | Ronen et al. | |
| 7,910,800 B2 | 3/2011 | Karchi et al. | |
| 8,049,069 B2 | 11/2011 | Wu et al. | |
| 8,168,857 B2 | 5/2012 | Ayal et al. | |
| 8,426,682 B2 | 4/2013 | Ronen et al. | |
| 2001/0046316 A1 | 11/2001 | Miyano et al. | |
| 2002/0046419 A1 | 4/2002 | Choo et al. | |
| 2002/0049999 A1 | 4/2002 | Allen et al. | |
| 2002/0148007 A1 | 10/2002 | Jiao et al. | |
| 2002/0160378 A1 | 10/2002 | Harper et al. | |
| 2002/0170088 A1 | 11/2002 | Wilkins | |
| 2003/0005485 A1 | 1/2003 | Ohlrogge et al. | |
| 2003/0074697 A1 | 4/2003 | Allen et al. | |
| 2003/0084485 A1 | 5/2003 | Zhu et al. | |
| 2003/0162294 A1 | 8/2003 | Verbruggen | |
| 2003/0163839 A1 | 8/2003 | Helentjaris et al. | |
| 2003/0233670 A1 | 12/2003 | Edgerton et al. | |
| 2004/0006794 A1 | 1/2004 | Wilkins | |
| 2004/0019927 A1 | 1/2004 | Sherman et al. | |
| 2004/0031072 A1 | 2/2004 | La Rosa et al. | |
| 2004/0034888 A1 | 2/2004 | Liu et al. | |
| 2004/0123343 A1 | 6/2004 | La Rosa et al. | |
| 2004/0172684 A1 | 9/2004 | Kovalic et al. | |
| 2004/0181830 A1* | 9/2004 | Kovalic et al. ............... 800/289 |
| 2004/0236225 A1 | 11/2004 | Murphy et al. | |
| 2005/0096515 A1 | 5/2005 | Geng | |
| 2005/0108791 A1 | 5/2005 | Edgerton | |
| 2006/0048240 A1 | 3/2006 | Alexandrov et al. | |
| 2006/0101543 A1 | 5/2006 | Somerville et al. | |
| 2006/0107345 A1 | 5/2006 | Alexandrov et al. | |
| 2006/0123505 A1 | 6/2006 | Kikuchi et al. | |
| 2006/0123516 A1 | 6/2006 | Ronen et al. | |
| 2006/0137043 A1 | 6/2006 | Puzio et al. | |
| 2006/0143729 A1 | 6/2006 | Alexandrov et al. | |
| 2006/0150283 A1 | 7/2006 | Alexandrov et al. | |
| 2006/0168684 A1 | 7/2006 | Renz et al. | |
| 2006/0174373 A1 | 8/2006 | Gipmans et al. | |
| 2006/0179511 A1 | 8/2006 | Chomet et al. | |
| 2006/0183137 A1 | 8/2006 | Harper et al. | |
| 2006/0195943 A1 | 8/2006 | Feldmann et al. | |
| 2006/0206961 A1 | 9/2006 | Cirpus et al. | |
| 2006/0260002 A1 | 11/2006 | Ronen et al. | |
| 2006/0288451 A1 | 12/2006 | Val et al. | |
| 2007/0006345 A1 | 1/2007 | Alexandrov et al. | |
| 2007/0006346 A1 | 1/2007 | Alexandrov et al. | |
| 2007/0044171 A1 | 2/2007 | Kovalic et al. | |
| 2007/0044172 A1* | 2/2007 | Schneeberger et al. ....... 800/278 |
| 2007/0061916 A1 | 3/2007 | Kovalic et al. | |
| 2007/0124833 A1 | 5/2007 | Abad et al. | |
| 2007/0169219 A1 | 7/2007 | Nadzan et al. | |
| 2007/0214517 A1 | 9/2007 | Alexandrov et al. | |
| 2007/0261130 A1 | 11/2007 | Lightner et al. | |
| 2008/0072340 A1 | 3/2008 | Troukhan et al. | |
| 2008/0076179 A1 | 3/2008 | Hartel et al. | |
| 2008/0148432 A1* | 6/2008 | Abad ........................... 800/279 |
| 2008/0196120 A1 | 8/2008 | Wu et al. | |
| 2008/0301839 A1 | 12/2008 | Ravanello | |
| 2009/0089898 A1 | 4/2009 | Karchi et al. | |
| 2009/0093620 A1* | 4/2009 | Kovalic et al. ............... 536/23.1 |
| 2009/0094717 A1 | 4/2009 | Troukhan et al. | |
| 2009/0126042 A1 | 5/2009 | Ronen et al. | |
| 2009/0260109 A1 | 10/2009 | Ronen et al. | |
| 2010/0037352 A1 | 2/2010 | Alexandrov et al. | |
| 2010/0154077 A1 | 6/2010 | Emmanuel et al. | |
| 2010/0319088 A1 | 12/2010 | Ronen et al. | |
| 2011/0080674 A1 | 4/2011 | Durand | |
| 2011/0214206 A1 | 9/2011 | La Rosa et al. | |
| 2012/0060234 A1 | 3/2012 | Emmanuel et al. | |
| 2012/0084885 A1 | 4/2012 | Alexandrov et al. | |
| 2012/0096587 A1 | 4/2012 | Vinocur et al. | |
| 2012/0180164 A1 | 7/2012 | Ayal et al. | |
| 2012/0222169 A1 | 8/2012 | Ronen et al. | |
| 2012/0297504 A1 | 11/2012 | Granevitze et al. | |
| 2013/0125258 A1 | 5/2013 | Emmanuel et al. | |
| 2013/0167265 A1 | 6/2013 | Panik et al. | |
| 2013/0219562 A1 | 8/2013 | Ronen et al. | |
| 2013/0239255 A1 | 9/2013 | Ronen et al. | |
| 2013/0276169 A1 | 10/2013 | Poraty et al. | |
| 2013/0291223 A1 | 10/2013 | Emmanuel et al. | |

FOREIGN PATENT DOCUMENTS

| | | |
|---|---|---|
| CN | 1823168 | 8/2006 |
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |

(56) References Cited

FOREIGN PATENT DOCUMENTS

| | | |
|---|---|---|
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |

OTHER PUBLICATIONS

Invitation to Pay Additional Fees Dated Feb. 7, 2008 From the International Searching Authority Re.: Application No. PCT/IL06/001223.

International Search Report and the Written Opinion Dated Jul. 29, 2008 From the International Searching Authority Re.: Application No. PCT/IL06/001223.

Supplementary European Search Report and the European Search Opinion Dated Sep. 14, 2009 From the European Patent Office Re.: Application No. 06809784.9.

Grover et al. "Understanding Molecular Alphabets of the Plant Abiotic Stress Responses", Current Science, 80(2): 206-216, Jan. 25, 2001.

Liu et al. "Root-Specific Expression of a Western White Pine PR10 Gene is Mediated by Different Promoter Regions in Transgenic Tobacco", Plant Molecular Biology, 52: 103-120, 2003.

Communication Pursuant to Article 94(3) EPC Dated Dec. 8, 2008 From the European Patent Office Re.: Application No. 04734072.4.

International Preliminary Report on Patentability Dated Dec. 8, 2005 From the International Bureau of WIPO Re.: Application No. PCT/IL2004/000431.

Invitation to Pay Additional Fees Dated Dec. 18, 2008 From the International Searching Authority Re.: Application No. PCT/IL08/01024.

Communication Pursuant to Article 94(3) EPC Dated Sep. 9, 2009 From the European Patent Office Re.: Application No. 04734072.4.

Communication Pursuant to Article 94(3) EPC Dated Nov. 27, 2009 From the European Patent Office Re.: Application No. 06809784.9.

Examination Report Dated Nov. 13, 2007 From the Government of India, Patent Office Re.: Application No. 3482/CHENP/2005.

International Preliminary Report on Patentability Dated Feb. 4, 2010 From the International Bureau of WIPO Re.: Application No. PCT/IL2008/001024.

International Preliminary Report on Patentability Dated Jan. 22, 2009 From the International Bureau of WIPO Re.: Application No. PCT/IL2006/000947.

International Search Report Dated Mar. 4, 2009 From the International Searching Authority Re.: Application No. PCT/IL08/01024.

International Search Report Dated Nov. 4, 2005 From the International Searching Authority Re.: Application No. PCT/IL04/00431.

International Search Report Dated Aug. 27, 2008 From the International Searching Authority Re.: Application No. PCT/IL06/00947.

Office Action Dated Jan. 9, 2009 From the State Intellectual Property Office of the People's Republic of China Re.: Application No. 200480020597.0.

Office Action Dated Apr. 27, 2009 From the Israeli Patent Office Re.: Application No. 172135 and Its Translation Into English.

Office Action Dated Jan. 31, 2010 From the Israel Patent Office Re.: Application No. 172135 and Its Translation Into English.

Office Letter Dated Jul. 7, 2008 From the Government of India, Patent Office Re.: Application No. 3482/CHENP/2005.

Official Action Dated May 15, 2009 From the US Patent and Trademark Office Re.: U.S. Appl. No. 11/990,386.

Official Action Dated Oct. 18, 2007 From the US Patent and Trademark Office Re.: U.S. Appl. No. 11/284,236.

Official Action Dated Oct. 22, 2009 From the US Patent and Trademark Office Re.: U.S. Appl. No. 11/990,386.

Official Action Dated Jul. 28, 2008 From the US Patent and Trademark Office Re.: U.S. Appl. No. 11/284,236.

Response Dated Jan. 7, 2010 to Communication Pursuant to Article 94(3) EPC of Sep. 9, 2009 From the European Patent Office Re.: Application No. 04734072.4.

Response Dated Feb. 22, 2010 to Official Action of Oct. 22, 2009 From the US Patent and Trademark Office Re.: U.S. Appl. No. 11/990,386.

Supplementary European Search Report and the European Search Opinion Dated Feb. 1, 2010 From the European Patent Office Re.: Application No. 06766224.7.

Supplementary European Search Report Dated Oct. 31, 2007 From the European Patent Office Re.: Application No. 04734072.4.

Supplementary Partial European Search Report Dated Aug. 30, 2007 From the European Patent Office Re.: Application No. 04734072.4.

Translation of the Office Action Dated Jan. 9, 2009 From the State Intellectual Property Office Re.: Application No. 2004800200597.0.

Written Opinion Dated Mar. 4, 2009 From the International Searching Authority Re.: Application No. PCT/IL08/01024.

Written Opinion Dated Aug. 27, 2008 From the International Searching Authority Re.: Application No. PCT/IL06/00947.

Alcala et al. "Generation of ESTs From Tomato Fruit Tissue", Database GenBank on STIC, National Center for Biotechnology Information, Accession No. AW932839, 2001.

Brandle et al. "Perspectives on the Production of Recombinant Proteins in Plants", AgBiotechNet, 3(ABN 070): 1-4, 2001. Abstract.

Guo et al. "Protein Tolerance to Random Amino Acid Change", Proceedings of the National Academy of Sciences USA, 101(25): 9205-9210, 2004.

Hill et al. "Functional Analysis of Conserved Histidines in ADP-Glucose Pyrophosphorylase From *Escherichia coli*", Biochemical and Biophysical Research Communications, 244(2): 573-577, 1998.

In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.

Keskin et al. "A New, Structurally Nonredundant, Diverse Data Set of Protein-Protein Interfaces and Its Implications", Protein Science, 13: 1043-1055, 2004.

Kim et al. "Molecular Cloning of Low-Temperature-Inducible Ribosomal Proteins From Soybean", Journal of Experimental Botany, 55(399): 1153-1155, 2004.

Nuccio et al. "Metabolic Engineering of Plants for Osmotic Stress Resistance", Current Opinion in Plant Biology, XP002216348, 2(2): 128-134, Apr. 1, 1999.

Park et al. "Glycine Max Ribosomal Protein S13 (RPS13) mRNA, Complete Cds",.Database EMBL [Online], Retreieved From EBI Accession No. EMBL, Database Accession No. AY453393, 2004.

(56) References Cited

OTHER PUBLICATIONS

Sáez-Vásquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Smart et al. "MIP Genes are Down-Regulated Under Drought Stress in *Nicotiana glauca*", Plant and Cell Physiology, 42(7): 686-693, 2001. Referene to Database Entry AF290618 on p. 686, p. 692, 1-h col., § 2.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
Wells "Additivity of Mutational Effects in Proteins", Biochemistry, 29 (37): 8509-8517, 1990.
Examination Report Dated Feb. 17, 2010 From the Instituto Mexicano de la Propriedad Industrial Re. Application No. PA/a/2005/012565 and Its Summary in English.
Communication Pursuant to Article 94(3) EPC Dated May 12, 2010 From the European Patent Office Re.: Application No. 06766224.7.
Response Dated May 31, 2010 to Office Action of Jan. 31, 2010 From the Israel Patent Office Re.: Application No. 172135.
International Preliminary Report on Patentability Dated Jul. 8, 2010 From the International Bureau of WIPO Re.: Application No. PCT/IL2008/001657.
Office Action Dated Jun. 17, 2010 From the Israel Patent Office Re. Application No. 190918 and Its Translation Into English.
Supplementary European Search Report and the European Search Opinion Dated Jul. 29, 2010 From the European Patent Office Re. Application No. 08776651.5.
Invitation to Pay Additional Fees Dated Aug. 23, 2005 From the International Search Authority Re. Application No. PCT/IL2004/000431.
Office Action Dated Aug. 4, 2010 From the Israel Patent Office Re.: Application No. 172135 and Its Translation Into English.
Communication Pursuant to Article 94(3) EPC Dated Feb. 13, 2009 From the European Patent Office Re.: Application No. 05750089.4.
European Search Report and the European Search Opinion Dated Aug. 9, 2010 From the European Patent Office Re.: Application No. 09163033.5.
Examiner's Report Dated Dec. 17, 2009 From the Australian Patent Office Re.: Application No. 2005252469.
International Preliminary Report on Patentability Dated Jan. 14, 2010 From the International Bureau of WIPO Re.: Application No. PCT/IL2008/000489.
International Preliminary Report on Patentability Dated Jan. 21, 2010 From the International Bureau of WIPO Re.: Application No. PCT/IL2007/001590.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Nov. 24, 2008 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
Invitation to Pay Additional Fees Dated Sep. 8, 2006 From the International Searching Authority Re.: Application No. PCT/IL05/00627.
Notice of Allowance Dated Apr. 16, 2010 From the US Patent and Trademark Office Re.: U.S. Appl. No. 11/629,411.
Office Action Dated May 13, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Partial European Search Report Dated Apr. 19, 2010 From the European Patent Office Re.: Application No. 09163033.5.
Response Dated Jan. 4, 2010 to Official Action of Sep. 2, 2009 From the US Patent and Trademark Office Re.: U.S. Appl. No. 11/629,411.
Response Dated May 17, 2010 to Office Action of Jan. 22, 2010 From the State Intellectual Property Office of the People's Republic of China Re.: Application No. 200580027481.4.
Supplementary European Search Report and the European Search Opinion Dated Jul. 1, 2010 From the European Patent Office Re. Application No. 07849616.3.
Supplementary European Search Report and the European Search Opinion Dated Aug. 11, 2010 From the European Patent Office Re. Application No. 08738191.9.
Supplementary European Search Report Dated Apr. 23, 2008 From the European Patent Office Re.: Application No. 05750089.4.
Translation of Notice of Payment of the Restoration Fee for Unity of Invention Dated Mar. 20, 2009 From the State Intellectual Property Office of the People's Republic of China Re.: Application No. 200580027481.4.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Bowie et al. "Deciphering the Message in Protein Sequences: Tolerance to Amino Acid Substitutions", Science, 247(4948): 1306-1310, Mar. 16, 1990.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
François et al. "Overexpression of the VvLTP1 Gene Interferes With Somatic Embryo Development in Grapevine", Functional Plant Biology, 35(5): 394-402, 2008.
Ji et al. "*Gossypium hirsutum* Expansin mRNA, Complete CDs", XP002474936, Retrieved From EBI Accession No. EMBL:AY189969, Database Accession No. AY189969.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.

(56) References Cited

OTHER PUBLICATIONS

Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kirubakaran et al. "Characterization of a New Antifungal Lipid Transfer Protein From Wheat", Plant Physiology and Biochemistry, 46: 918-927, 2008.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Udall et al. "A Global Assembly of Cotton ESTs", Genome Research, 16(3): 441-450, 2006.
Wallace et al. "Oligonucleotide Probes for the Screening of Recombinant DNA Libraries", Methods in Enzymology, XP002957829, 152: 432-442, Jan. 1, 1987.
Wing et al. "An Integrated Analysis of the Genetics, Devlopment, and Evolution of Cotton Fiber", NBCI' GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Response Dated Sep. 13, 2010 to Office Action Dated May 13, 2010 From the Israel Patent Office Re. Application No. 180022.
Communication Pursuant to Rule 70(2) EPC and Reference to Rule 39(1) EPC Dated Sep. 13, 2010 From the European Patent Office Re.: Application No. 09163033.5.
Response Dated Sep. 21, 2010 to Notice of Allowance of Apr. 16, 2010 From the US Patent and Trademark Office Re.: U.S. Appl. No. 11/629,411.
Response Dated Oct. 12, 2010 to Communication Pursuant to Article 94(3) EPC of May 12, 2010 From the European Patent Office Re.: U.S. Appl. No. 06766224.7.
Response Dated Oct. 14, 2010 to Office Action of Jun. 17, 2010 From the Israel Patent Office Re. Application No. 190918.
Examiner'Report Dated Dec. 17, 2009 From the Australian Patent Office Re.: Application No. 2005252469.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Sá ez-Vásquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Wu et al. "SubName: Full=Major Intrinsic Protein", Database UniProt [Online], XP002529191, Retrieved From EBI Accession No. UNIPROT:AOF189, Database Accession No. AOF189, Nov. 28, 2006.
Communication Pursuant to Article 94(3) EPC Dated Nov. 8, 2010 From the European Patent Office Re.: Application No. 04734072.4.
Communication Pursuant to Article 94(3) EPC Dated Nov. 19, 2010 From the European Patent Office Re.: Application No. 06809784.9.
Examination Report Dated Nov. 3, 2010 From the Government of India, Patent Office Re.: Application No. 158/CHENP/2007.
Examination Report Dated Sep. 22, 2010 From the Instituto Mexican de la Propriedad Industrial Re. Application No. MX/a/2008/005280 and Its Summary Into English.
International Search Report and the Written Opinion Dated Feb. 17, 2010 From the International Searching Authority Re.: Application No. PCT/IL09/00508.
Invitation to Pay Additional Fees Dated Nov. 19, 2009 From the International Searching Authority Re.: Application No. PCT/IL09/00508.
Office Action Dated Oct. 18, 2010 From the Israel Patent Office Re. Application No. 180022 and Its Translation Into English.
Yamada et al. "*Arabidopsis thaliana* Clone RAFL14-87-A16 (R20399) Unknown Protein (At1g60770) mRNA, Complete Cds", GenBank Accession No. BT002876, Retrieved From the internet, Jan. 21, 2010.
International Preliminary Report on Patentability Dated Dec. 2, 2010 From the International Bureau of WIPO Re. Application No. PCT/IL2009/000508.
Notice of Allowance Dated Oct. 18, 2010 From the US Patent and Trademark Office Re.: U.S. Appl. No. 11/990,386.
Office Action Dated Nov. 11, 2010 From the Israel Patent Office Re. Application No. 206118 and Its Translation Into English.
Response Dated Dec. 5, 2010 to Office Action of Aug. 4, 2010 From the Israel Patent Office Re.: Application No. 172135.
Response Dated Dec. 12, 2010 to Examiner's Report of Dec. 17, 2009 From the Australian Patent Office Re.: Application No. 2005252469.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Summary of Office Action Dated Sep. 2, 2010 From the Rospatent, Federal State Institution, Federal Institute for Industrial Property of the Federal Service for Intellectual Property, Patents and Trademarks of the Russian Federation Re. Application No. 2008120395.
Translation of Office Action Dated Oct. 19, 2010 From the State Intellectual Property Office of the People's Republic of China Re. Application No. 200680038391.X.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
Notice of Grant Dated Jan. 14, 2011 From the Instituto Mexicano de la Propriedad Industrial Re. Application No. MX/a/2008/005280.
Examiner's Report Dated Jan. 13, 2011 From the Australian Patent Office Re.: Application No. 2005252469.
Response Dated Jan. 19, 2011 to Supplementary European Search Report and the European Search Opinion of Jul. 1, 2010 From the European Patent Office Re. Application No. 07849616.3.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Li et al. "Isolation of Genes Preferntially Expressed in Cotton Fibers by cDNA Filter Arrays and RT-PCR", Plant Science, 163: 1113-1120, 2002. & GenBank Nucleotide "*Gossypium hirstutum* Dehydration-Iduced Protein RD22-Like Protein (RDLO mRNA, Complete CDS", GenBank Accession No. AY072821, Dec. 4, 2002.
Office Action Dated Feb. 3, 2011 From the Israel Patent Office Re.: Application No. 172135 and Its Translation Into English.
Official Action Dated Feb. 15, 2011 From the US Patent and Trademark Office Re. U.S. Appl. No. 12/448,359.
Communication Pursuant to Article 94(3) EPC Dated Mar. 8, 2011 From the European Patent Office Re.: Application No. 06809784.9.
Communication Pursuant to Article 94(3) EPC Dated Mar. 14, 2011 From the European Patent Office Re. Application No. 07849616.3.

(56) References Cited

OTHER PUBLICATIONS

International Preliminary Report on Patentability Dated Mar. 3, 2011 From the International Bureau of WIPO Re.: Application No. PCT/IB2009/053633.
International Search Report and the Written Opinion Dated Jun. 2, 2010 From the International Searching Authority Re. Application No. PCT/IB09/53633.
Invitation to Pay Additional Fees Dated Mar. 2, 2010 From the International Searching Authority Re.: Application No. PCT/IB09/53633.
Response Dated Feb. 9, 2011 to Communication Pursuant to Article 94(3) EPC of Nov. 19, 2010 From the European Patent Office Re.: Application No. 06809784.9.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Communication Pursuant to Rules 70(2) and 70a(2) EPC Dated Aug. 30, 2010 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communication Pursuant to Rules 70(2) and 70a(2) EPC of Aug. 30, 2011 From the European Patent Office Re. Application No. 08738191.9.
Examiner's Report Dated Mar. 31, 2011 From the Australian Government, IP Australia Re.: Application No. 2005252469.
Response Dated Mar. 8, 2011 to Examiner's Report of Jan. 13, 2011 From the Australian Government, IP Australia Re.: Application No. 2005252469.
Response Dated Mar. 9, 2011 to Office Action of Nov. 11, 2010 From the Israel Patent Office Re. Application No. 206118.
Response Dated Mar. 24, 2011 to Examination Report of Nov. 3, 2010 From the Government of India, Patent Office Re.: Application No. 158/CHENP/2007.
Official Action Dated May 10, 2011 From the US Patent and Trademark Office Re. U.S. Appl. No. 12/457,199.
Official Action Dated Apr. 29, 2011 From the US Patent and Trademark Office Re. U.S. Appl. No. 12/448,359.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Payne et al. "Heterologous MYB Genes Distinct From GL1 Enhance Trichome Production When Overexpressed in *Nicotiana tabacum*", Development, 126: 671682, 1999.
Sunkar et al. "Small RNAs as Big Players in Plant Abiotic Stress Responses and Nutrient Deprivation", Trends in Plant Science XP022148764, 12(7): 301-309, Jul. 1, 2007.
Communication Pursuant to Rules 70(2) and 70a(2) EPC Dated May 24, 2011 From the European Patent Office Re. Application No. 09750276.9.
Examination Report Dated Apr. 19, 2011 From the Instituto Mexican de la Propriedad Industrial Re. Application No. MX/a/2008/002262 and Its Summary Into English.
Requisition by the Examiner Dated Jun. 15, 2011 From the Canadian Intellectual Property Office Re. Application No. 2,526,440.
International Search Report and the Written Opinion Dated Dec. 6, 2011 From the International Searching Authority Re. Application No. PCT/IB2011/051843.
Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.

Translation of Notification of the Office Action Dated Dec. 1, 2011 From the State Intellectual Property Office of the People's Republic of China Re. Application No. 200680047610.0.
Response Dated Dec. 19, 2011 to Examiner's Report of Oct. 19, 2011 From the Australian Government, IP Australia Re. Application No. 2006281018.
Response Dated Jun. 29, 2011 to Communication Pursuant to Article 94(3) EPC of Mar. 8, 2011 From the European Patent Office Re.: Application No. 06809784.9.
Communication Pursuant to Article 94(3) EPC Dated Jan. 3, 2013 From the European Patent Office Re. Application No. 09807983.3.
Communication Pursuant to Article 94(3) EPC Dated Dec. 19, 2012 From the European Patent Office Re.: Application No. 04734072.4.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Examiner's Report Dated Jan. 10, 2012 From the Australian Government, IP Australia Re. Application No. 2005234725.
Official Action Dated Dec. 21, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of A Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics, 7(3): 225-242, 2006.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Examination Report Dated Jun. 11, 2012 From the Instituto Mexicano de la Propiedad Industrial Re. Application No. MX/a/2011/007294 and Summary in English.
Examiner's Report Dated Jan. 13, 2012 From the Australian Government, IP Australia Re. Application No. 2011239323.
Response Dated Dec. 22, 2011 to Official Action of Aug. 22, 2011 From the US Patent and Trademark Office Re. U.S. Appl. No. 12/457,199.
Supplementary European Search Report and the European Search Opinion Dated Jan. 2, 2012 From the European Patent Office Re. Application No. 09807983.3.
Translation of Decision of Rejection Dated Dec. 9, 2011 From the State Intellectual Property Office of the People's Republic of China Re.: Application No. 200580027481.4.

(56) References Cited

OTHER PUBLICATIONS

Adachi et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Feng et al. "Probable Cinnamyl Alcohol Dehydrogenase 6", Darabase UniProt [Online], XP002665609, Retrieved From EBI, Database Accession No. Q7XWII3, Mar. 1, 2004.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 13, 2012 From the Thai Patent Office, Department of Intellectual Property Office Re. Application No. 0901000235.
International Search Report and the Written Opinion Dated Aug. 22, 2011 From the International Searching Authority Re: Application No. PCT/IB2010/56023.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examiner's Report Dated Jan. 31, 2012 From the Australian Government, IP Australia Re. Application No. 2006281018.
International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.
International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Office Action Dated Jan. 2, 2012 From the Israel Patent Office Re. Application No. 206118 and Tts Translation Into English.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.
Restriction Official Action Dated Feb. 1, 2012 From the US Patent and Trademark Office Re. U.S. Appl. No. 12/669,975.
Restriction Official Action Dated Feb. 13, 2012 From the US Patent and Trademark Office Re. U.S. Appl. No. 12/594,853.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS(Engineering in Medicine and Biology) Annual International Conference, New York City, USA, Aug. 30-Sep. 3, 2006, XP031235634, p. 953-956, Aug. 30, 2006. p. 953, § 2, 3.
Aksenov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.1.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Kaczmarek et al. "Optical Excitation Methods in Active Dynamic Thermography in Medical Diagnostics", Proceedings of the SPIE—The International Society for Optical Engineering SPIE, XP002519609, 5566(1): 120-126, 2004. p. 121, Last §, p. 123, First §, Fig.3.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig. S.
International Preliminary Report on Patentability Dated Feb. 21, 2013 From the International Bureau of WIPO Re. Application No. PCT/IB2011/051843.
Official Action Dated Feb. 8, 2013 From the US Patent and Trademark Office Re. U.S. Appl. No. 12/594,853.
Supplementary European Search Report and the European Search Opinion Dated Feb. 14, 2013 From the European Patent Office Re. Application No. 10785834.2.
Translation of Office Action Dated Jan. 4, 2012 From the State Intellectual Property Office of the People's Republic of China Re. Application No. 200880109464.9.

(56) References Cited

OTHER PUBLICATIONS

Translation of Office Action Dated Jan. 17, 2012 From the State Intellectual Property Office of the People's Republic of China Re. Application No. 201110104274.1.
Translation of Office Action Dated Dec. 31, 2011 From the State Intellectual Property Office of the People's Republic of China Re. Application No. 200910217137.1.
Translation of Office Action Dated Feb. 25, 2013 From the State Intellectual Property Office of the People's Republic of China Re. Application No. 200910217137.1.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
Restriction Official Action Dated Mar. 1, 2013 From the US Patent and Trademark Office Re. U.S. Appl. No. 13/254,183.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Examiner's Report Dated Mar. 15, 2012 From the Australian Government, IP Australia Re. Application No. 2011239323.
International Preliminary Report on Patentability Dated Mar. 14, 2013 From the International Bureau of WIPO Re. Application No. PCT/IB2011/053697.
Restriction Official Action Dated Apr. 4, 2013 From the US Patent and Trademark Office Re. U.S. Appl. No. 13/125,047.
Communication Pursuant to Rule 55 EPC Dated Mar. 16, 2012 From the European Patent Office Re. Application No. 11190921.4.
Restriction Official Action Dated Apr. 11, 2012 From the US Patent and Trademark Office Re. U.S. Appl. No. 12/834,106.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Communication Pursuant to Article 94(3) EPC Dated Apr. 3, 2012 From the European Patent Office Re.: Application No. 06766224.7.
Official Action Dated Apr. 10, 2012 From the US Patent and Trademark Office Re. U.S. Appl. No. 12/669,975.
Invitation to Pay Additional Fees Dated May 8, 2012 From the International Searching Authority Re. Application No. PCT/IB11/53697.
Translation of Office Action Dated Apr. 9, 2012 From the State Intellectual Property Office of the People's Republic of China Re. Application No. 200880017707.6.
Examination Report Dated Mar. 23, 2013 From the Government of India, Patent Office, Intellectual Property Building Re. Application No. 2570/CHENP/2008.
Office Action Dated Apr. 1, 2013 From the State Intellectual Property Office of the People's Republic of China Re. Application No. 200880127757.X and Its Translation Into English.
Communication Pursuant to Article 94(3) EPC Dated May 8, 2013 From the European Patent Office Re. Application No. 08776651.5.
Official Action Dated May 14, 2012 From the US Patent and Trademark Office Re. U.S. Appl. No. 12/457,199.
International Search Report and the Written Opinion Dated May 12, 2013 From the International Searching Authority Re. Application No. PCT/IL2013/050172.
Official Action Dated May 8, 2013 From the US Patent and Trademark Office Re. U.S. Appl. No. 13/125,047.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [*Medicago truncatula*]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in *Arabidopsis*", The Plant Cell, 24: 4555-4576, Nov. 2012.
Official Action Dated May 20, 2013 From the US Patent and Trademark Office Re. U.S. Appl. No. 13/059,231.
Patent Examination Report Dated May 31, 2013 From the Australian Government, IP Australia Re. Application No. 2008278654.
Hirner et al. "*Arabidopsis* LHT1 is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From *Arabidopsis*", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Communication Pursuant to Article 93(3) EPC Dated Jun. 15, 2012 From the European Patent Office Re. Application No. 11154193.4.
Communication Pursuant to Article 94(3) EPC Dated Jun. 21, 2012 From the European Patent Office Re. Application No. 11154213.0.
Official Action Dated Jun. 13, 2012 From the US Patent and Trademark Office Re. U.S. Appl. No. 12/594,853.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Relating to the Results of the Partial International Search Dated Jul. 8, 2009 From the International Searching Authority Re.: Application No. PCT/IL2008/001657.
International Search Report and the Written Opinion Dated Oct. 30, 2009 From the International Searching Authority Re.: Application No. PCT/IL2008/001657.
Fray et al. "Nucleotide Sequence and Expression of a Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.
Kirkness et al. "*Lycopersicon esculentum* Clone 133453R, mRNA Sequence", Database EMBL [Online], XP002529190, Retrieved From EBI Accession No. EMBL:BT014251, Database Accession No. BT014251, May 12, 2004.
Maurel "Plant Aquaporins: Novel Functions and Regulation Properties", FEBS Letters, XP022078418, 581(12): 2227-2236, May 25, 2007. p. 2230, col. 2, Last § -p. 2231, col. 1, § 2, Fig.1.

(56) References Cited

OTHER PUBLICATIONS

Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Communication Pursuant to Article 94(3) EPC Dated May 29, 2013 From the European Patent Office Re. Application No. 09823171.5.
Examination Report Dated Mar. 13, 2013 From the Instituto Mexicano de la Propiedad Industrial Re. Application No. PA/a/2005/009380 and Its Summary in English.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
Patent Examination Report Dated Jun. 27, 2013 From the Australian Government, IP Australia Re. Application No. 2012216482.
Requisition—Sequence Listing Dated May 8, 2013 From the Canadian Intellectual Property Office Re. Application No. 2,753,616.
*Arabidopsis* Genome Initiative "Analysis of the Genome Sequence of the Flowering Plant *Arabicopsis thaliana*" Nature, 408: 796-815, Dec. 14, 2000.
Ciddi et al. "Elicitation of Taxus SP. Cell Cultures for Production of Taxol", Biotechnology Letters, 17(12): 1343-1346, Dec. 1995.
Kikuchi et al. "*Oryza sativa* Japonica Group cDNA Clone:J023131O04, Full Insert Sequence", GenBank Database Accession No. AK072531, Jul. 2, 2013.
Lurin et al. "Genome-Wide Analysis of *Arabidopsis* Pentatricopeptide Repeat Proteins Reveals Their Essential Role in Organelle Biogenesis", The plant Cell, 16: 2089-2103, Aug. 2004.
Matz et al. "*Gossypium hirsutum* GHDEL65 (ghde165) mRNA, Complete CDS", GenBank Nucleotide, GenBank Accession No. AF336280, Mar. 15, 2001.
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
International Preliminary Report on Patentability Dated Jul. 4, 2013 From the International Bureau of WIPO Re. Application No. PCT/IB2011/055854.
International Search Report and the Written Opinion Dated Aug. 6, 2012 From the International Searching Authority Re. Application No. PCT/IB11/53697.
Daniell et al. "*Solanum bulbocastanum* Chloroplast, Complete Genome", GenBank NCBI, Accession No. NC_007943, Mar. 26, 2010. p. 1, Source, p. 10-11, Nucleotides 46590-47195, Gene 'RPS4'.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes a bHLH Protein That Regulates Trichome Development in *Arabidopsis* Through Interaction With GL1 and TTG1", Genetics, 156: 1349-1362, Nov. 2000.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
Advisory Action Before the Filing of an Appeal Brief Dated Aug. 29, 2012 From the US Patent and Trademark Office Re. U.S. Appl. No. 12/457,199.

Examination Report Dated Aug. 16, 2012 From the Instituto Mexicano de la Propiedad Industrial Re. Application No. MX/a/2010/014097 and Its Translation Into English.
Examination Report Dated Jun. 7, 2013 From the Instituto Mexicano de la Propiedad Industrial Re. Application No. MX/a/2011/003575 and Its Translation Into English.
Examination Report Dated Jun. 20, 2013 From the Instituto Mexicano de la Propicdad Industrial Re. Application No. MX/a/2011/007294 and Its Translation Into English.
International Search Report and the Written Opinion Dated Sep. 1, 2013 From the International Searching Authority Re. Application No. PCT/IB2013/054374.
Bennetzen et al. "*Setaria italica* Strain Yugul SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
NCBI "Predicted: Nudix Hydrolase 16, Mitochondrial-Like [*Setaria italica*]", Database NCBI [Online], NCBI Reference Sequence: XP_004955808, Jun. 26, 2013.
Communication Pursuant to Article 94(3) EPC Dated Aug. 20, 2013 From the European Patent Office Re. Application No. 11172514.9.
Official Action Dated Sep. 16, 2013 From the US Patent and Trademark Office Re. U.S. Appl. No. 13/125,047.
Translation of Office Action Dated Aug. 28, 2013 From the State Intellectual Property Office of the People's Republic of China Re. Application No. 200880109464.9.
Clontech "Genome Walker™ Universal Kit User Manual", Clontech Laboratories Inc., Cat. No. 638904, PT3042-1 (PR742239), p. 1-30, Apr. 25, 2007.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
International Preliminary Report on Patentability Dated Sep. 15, 2011 From the International Bureau of WIPO Re. Application No. PCT/IB2010/050871.
International Search Report and the Written Opinion Dated Sep. 7, 2010 From the International Searching Authority Re. Application No. PCT/IB10/50871.
Invitation to Pay Additional Fees Dated Jun. 9, 2011 From the International Searching Authority Re. Application No. PCT/IB10/56023.
Invitation to Pay Additional Fees Dated Aug. 18, 2011 From the International Searching Authority Re.: Application No. PCT/IL08/00489.
Official Action Dated Aug. 22, 2011 From the US Patent and Trademark Office Re. U.S. Appl. No. 12/457,199.
Response Dated Sep. 25, 2011 to Examiner's Report of Jun. 30, 2011 From the Australian Government, IP Australia Re. Application No. 2006307457.
Apse et al. "Engineering Salt Tolerance in Plants", Current Opinion in Biotechnology, 13: 146-150, 2002.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004
Hattori et al. "An Acetohydroxy Acid Synthase Mutant Reveals a Single Site Involved in Multiple Herbicide Resistance", Molecular and General Genetics, 246: 419-425, 1995. Abstract!
Holmstr?m et al. "Drought Tolerance in Tobacco", Nature, 379: 683-684, 1996. Abstract!
Jiao et al.
Johansson et al. "The Role of Aquaporins in Cellular and Whole Plant Water Balance," Biochimica et Biophysica Acta 1465: 324-342, 2000.
Katavic et al. "Utility of the *Arabidopsis* FAE1 and Yeast SLC1-1 Genes for Improvement in Erucic Acid and Oil Content in Rapeseed", Biochemical Society Transactions, 28(6): 935-937, Dec. 2000.

(56) References Cited

OTHER PUBLICATIONS

Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Pilon-Smits et al. "Improved Performance of Transgenic Fructan-Accumulating Tobacco under Drought Stress", Plant Physiology, 107: 125-130, 1995.
Quesada et al. "Genetic Architecture of NaC1 Tolerance in *Arabidopsis*", Plant Physiology, 130: 951-963, 2002. Abstract!
Saijo et al. "Over-Expression of a Single Ca 2+ -Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Tarczynski et al. "Stress Protection of Transgenic Tobacco by Production of the Osmolyte Mannitol", Science, 259: 508-510, 1993. Abstract!
van Haaren et al. "A Functional Map of the Fruit-Specific Promoter of the Tomato 2A11 Gene", Plant Molecular Biology, 21: 625-640, 1993. Abstract!
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Whisstock et al. "Prediction of Protein Function from Protein Sequence and Structure," Quarterly Reviews of Biophysics 36 (3): 307-340, Aug. 2003.
Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yanagisawa et al. "Diversity and Similarity Among Recognition Sequences of Dof Transcription Factors", The Plant Journal, 17(2): 209-214, 1999.
Zabrouskov et al. "Oxidative Metabolism and the Physiological Age of Seed Potatoes are Affected by Increased Alpha-Linolenate Content", Physiologia Plantarum, 116: 172-185, 2002.
Examination Report Dated Jul. 29, 2013 From the Instituto Mexicano de la Propiedad Industrial Re. Application No. MX/a/2010/012697 and Its Translation Into English.
Official Action Dated Sep. 20, 2013 From the US Patent and Trademark Office Re. U.S. Appl. No. 12/669,975.
European Search Report and the European Search Opinion Dated Oct. 6, 2011 From the European Patent Office Re. Application No. 11172514.9.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM_EST:DW508992, Database Accession No. DW508992.
Taliercio et al. "GH_TMIRS_129_G10_R Cotton Normalized Library dT Primed *Gossypium hirsutum* cDNA, mRNA Sequence", EMBL-Bank, XP002659971, Retrieved From EBI Accession No. EM_EST:DW508993, Database Accession No. DW508993.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.

International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Bautista et al. "*Arabidopsis thaliana* At5g06690 mRNA, Complete Cds", Unpublished, The Salk Institute for Biological Studies, La Jolla, CA, USA, GenBank: BT029447, Nov. 16, 2006.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM_PL: BT022032.1, Database Accession No. BT022032, May 4, 2005.
Matsumoto et al. "*Hordeum vulgare* Subsp. Vulgare, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Response Dated Oct. 3, 2011 to Examiner's Report of Jun. 24, 2011 From the Australian Government, IP Australia Re. Application No. 2006281018.
Ngo et al. "Computational Complexity, Protein Structure Prediction, and the Levinthal Paradox", The Protein Folding Problem and Tertiary Structure Prediction, pp. 433, 492-495, 1994.
Van der Hoeven et al. "EST301295 Tomato Root During/After Fruit Set, Cornell University Lycopersicon Esculentum cDNA Clone cLEX1K11 Similar to *Vernicia fordii* Aquaporin, mRNA Sequence", Database EMBL [Online], Retrieved From EBI Accession No. EMBL: AW218815, XP002455681, Database Accession No. AW218815, Dec. 14, 1999. Abstract.
Communication Pursuant to Article 94(3) EPC Dated Oct. 9, 2013 From the European Patent Office Re. Application No. 08869158.9.

(56) References Cited

OTHER PUBLICATIONS

Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Supplementary European Search Report and the European Search Opinion Dated Oct. 15, 2013 From the European Patent Office Re. Application No. 10840687.7.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and is Used for the Same Purpose, Abstract, Sequence.
Paterson et al. "*Sorghum* Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Translation of Office Action Dated Sep. 13, 2012 From the State Intellectual Property Office of the People's Republic of China Re. Application No. 200910217137.1.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA, PNAS, XP002967292, 97(14): 7969-7974, Jul. 20, 2000.
Invitation to Pay Additional Fees Dated Oct. 17, 2012 From the International Searching Authority Re. Application No. PCT/IL2012/050154.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus *Solanum lycopersicum* cDNA Clone cLEC80A19 5-end, mRNA Sequence", GenBank: BI923254.1, GenBank Accession No. BI923254, Oct. 17, 2001.
Requisition by the Examiner Dated Aug. 27, 2013 From the Canadian Intellectual Property Office Re. Application No. 2,526,440.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propicdad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 *Arabidopsis* Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
European Search Report and the European Search Opinion Dated Nov. 2, 2011 From the European Patent Office Re. Application No. 10194223.3.
Examiner's Report Dated Oct. 19, 2011 From the Australian Government, IP Australia Re. Application No. 2006281018.
Examiner's Report Dated Oct. 28, 2011 From the Australian Government, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Response Dated Oct. 18, 2011 to Official Action of Sep. 19, 2011 From the US Patent and Trademark Office Re. U.S. Appl. No. 12/810,855.
Notice of Allowance Dated Nov. 19, 2012 From the US Patent and Trademark Office Re. U.S. Appl. No. 13/450,547.
Restriction Official Action Dated Nov. 13, 2012 From the US Patent and Trademark Office Re. U.S. Appl. No. 12/992,902.
Backhaus et al. "Nucleotide Sequence of a cDNA for a P2 60S Acidic Ribosomal Protein From *Parthenium argentatum*", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Advisory Action Before the Filing of an Appeal Brief Dated Nov. 19, 2013 From the US Patent and Trademark Office Re. U.S. Appl. No. 12/834,106.
International Search Report and the Written Opinion Dated Nov. 19, 2013 From the International Searching Authority Re. Application No. PCT/IL2013/050725.
Yu et al. "Cell Cycle Checkpoint Protein MAD2 Homolog [*Zea mays*]", Database NCBI' [Online], GenBank: AAD30555.1, GenBank Accession No. AAD30555, May 17, 1999.
Applicant-Initiated Interview Summary Dated Nov. 20, 2013 From the US Patent and Trademark Office Re. U.S. Appl. No. 13/125,047.
Requisition by the Examiner Dated Oct. 28, 2013 From the Canadian Intellectual Property Office Re. U.S. Appl. No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Communication Under Rule 71(3) EPC Dated Nov. 19, 2012 From the European Patent Office Re. Application No. 08738191.9.
Communication Pursuant to Article 94(3) EPC Dated Jun. 29, 2011 From the European Patent Office Re. Application No. 08738191.9.
Communication Pursuant to Rule 69 EPC—Reminder Concerning Payment of the Designation Fee (Art. 79(2) EPC) and of the Exami-

(56) References Cited

OTHER PUBLICATIONS nation Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Apr. 19, 2011 From the Instituto Mexicano de la Propriedad Industrial Re. Application No. MX/a/2008/002262 and Its Summary Into English.
Examination Report Dated Sep. 22, 2010 From the Instituto Mexicano de la Propriedad Industrial Re. Application No. MX/a/2008/005280 and Its Summary Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 13, 2011 From the Australian Government, IP Australia Re.: Application No. 2005252469.
Examiner's Report Dated Dec. 17, 2009 From the Australian Government, IP Australia Re.: Application No. 2005252469.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
International Search Report Dated May 18,2009 From International Searching Authority Re.: Application No. PCT/IL2008/001685.
Invitation to Pay Additional Fees Dated Jun. 9, 2011 From the International Searching Authority Re. Application No. PCT/IL10/56023.
Office Action Dated Jun. 19, 2011 From the Israel Patent Office Re. Application No. 199391 and Its Translation Into English.
Office Action Dated Jun. 20, 2011 From the Israel Patent Office Re. Application No. 190918 and Its Translation Into English.
Official Action Dated Sep. 19, 2011 From the US Patent and Trademark Office Re. U.S. Appl. No. 12/810,855.
Partial European Search Report Dated Jul. 12, 2011 From the European Patent Office Re. Application No. 10194223.3.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Jul. 6, 2011 to Examiner's Report of Dec. 20, 2010 From the Australian Government, IP Australia Re. Application No. 2005234725.
Response Dated Jun. 6, 2011 to Official Action of May 10, 2011 From the US Patent and Trademark Office Re. U.S. Appl. No. 12/457,199.
Response Dated Jun. 9, 2011 to Examiner's Report of Dec. 20, 2011 From the Australian Government, IP Australia Re. Application No. 2005234725.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009 From the Australian Government, IP Australia Re. Application No. 2005252469.

Response Dated Dec. 14, 2010 to Examination Report of Sep. 22, 2010 From the Instituto Mexicano de la Propriedad Industrial Re. Application No. MX/a/2008/005280.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated Jul. 20, 2011 to Examination Report of May 25, 2011 From the Government of India, Patent Office Re.: Application No. 158/CHENP/2007.
Response Dated Feb. 24, 2011 to Communciation Pursuant to Rules 70(2) and 70a(2) EPC of Aug. 30, 2011 From the European Patent Office Re. Application No. 08738191.9.
Response Dated Jul. 25, 2011 to Examiner's Report of Jul. 21, 2011 From the Australian Government, IP Australia Re. Application No. 2005234725.
Response Dated Jun. 29, 2010 to Examination Report of Feb. 17, 2010 From the Instituto Mexicano de la Propriedad Industrial Re. Application No. PA/a/2005/012565.
Translation of Notification of the First Office Action Dated Jun. 30, 2011 From the State Intellectual Property Office of the People's Republic of China Re. Application No. 200680047610.0.
Translation of Office Action Dated Jul. 1, 2011 From the State Intellectual Property Office of the People's Republic of China Re. Application No. 200880017707.6.
Written Opinion Dated Nov. 4, 2005 From the International Searching Authority Re.: Application No. PCT/IL04/00431.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA, Aug. 30-Sep. 3, 2006, XP031235634, p. 953-956, Aug. 30, 2006. p. 953, § 2, 3.
Apse et al. "Engineering Salt Tolerance in Plants", Current Opinion in Biotechnology, XP003018468, 13(2): 146-150, Apr. 1, 2002.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.l.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 87527, Abstract, Figs.4, 5.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Gardiner et al. "*Zea mays* PCO131392 mRNA Sequence", Database EMBL/GenBank/DDBJ, EBI Database Accession No. AY107021, XP002542347, May 28, 2002. 96.5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H+ -Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Guo et al. "Protein Tolerance to Random Amino Acid Change", Proc. Natl. Acad. Sci. USA, PNAS, 101(25): 9205-9210, 2004.
Ji et al. "*Gossypium hirsutum* Expansin mRNA, Complete CDs", Database EMBL [Online], XP002474936, Retrieved From EBIi Accession No. EMBL:AY189969, Database Accession No. AY189969, May 20, 2003.
Li et al. "*Gossypium hirsutum* Dehydration-Induced Protein RD22-Like Protein (RDL) mRNA, Complete CDS", EBI Accession No.

(56) References Cited

OTHER PUBLICATIONS

EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Moderhak et al. "Problems of 3D Breast Imaging", Gdansk University of Technology, Department of Biomedical Engineering, 2 P.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Smart et al. "MIP Genes are Down-Regulated Under Drought Stress in *Nicotiana glauca*", Plant and Cell Physiology, XP002455682, 42(7): 686-693, 2001. p. 686, Reference to Database Entry AF290618, p. 692, 1-h col., § 2.
Smart et al. "*Nicotiana glauca* Putative Delta TIP (MIP2) mRNA, Complete Cds", Database EMBL [Online], Retrieved From EBI Accession No. EMBL: AF290618, XP002455682, Database Accession No. AF290618.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, P. 658-659, Section 4, Fig.5.
Van der Hoeven et al. "EST301294 Tomato Root During/After Fruit Set, Cornell University Lycopersicon Esculent um cDNA Clone cLEX1K11 Similar to *Vernicia fordii* Aquaporin, mRNA Sequence", Database EMBL [Online], Retrieved From EBI Accession No. EMBL: AW218814, XP002455680, Database Accession No. AW218814, May 21, 2001. Abstract.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, XP002455681, Database Accession No. AW218815. Abstract.
Van der Hoeven et al. "EST312975 Tomato Root During/After Fruit Set, Cornell University *Solanum lycopersicum* cDNA Clone cLEX14O20 5-, mRNA Sequence", GenBank, GenBank Accession No. AW622177.1.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL, [Online], XP002640828, Retrieved From EBI Accession No. EMBL:AY034915, Database Accession No. AY034915, Jun. 13, 2001. Compound.
Examination Report Dated Oct. 1, 2013 From the Instituto Mexicano de la Propiedad Industrial Re. Application No. MX/a/2010/000975 and Its Translation Into English.
International Preliminary Report on Patentability Dated Nov. 14, 2013 From the International Bureau of WIPO Re. Application No. PCT/IL2012/050154.
Communication Pursuant to Article 94(3) EPC Dated Jul. 4, 2012 From the European Patent Office Re. Application No. 10194223.3.
Communication Pursuant to Article 94(3) EPC DAted Jul. 13, 2012 From the European Patent Office Re. Application No. 11172514.9.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:HV067703, Database Accession No. HV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide has 99.6% Identity to Present SEQ ID No.7 Over 488 Nucleotides. Abstract, Sequence.
La Rosa et al. "*Oryza sativa* Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Examination Report Dated May 23, 2013 From the Instituto Mexicano de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Official Action Dated Jul. 26, 2013 From the US Patent and Trademark Office Re. U.S. Appl. No. 13/254,183.
Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7O18 Genomic Sequence, Complete Sequence", GenBank Accession No. AC011437, Oct. 30, 2002.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Patent Examination Report Dated Dec. 12, 2012 From the Australian Government, IP Australia Re. Application No. 2008236316.
Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government, IP Australia Re. Application No. 2008278654.
Official Action Dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TIG, 14(6): 248-250, Jun. 1998.
Smith et al. "The Challenges of Genome Sequence Annotation or 'The Devil is in the Details'", Nature Biotechnology, 15: 1222-1223, Nov. 1997.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Examination Report Dated Dec. 16, 2013 From the Government of

(56) References Cited

OTHER PUBLICATIONS

India, Patent Office, Intellectual Property Building Re. Application No. 2570/CHENP/2008.
Li et al. "Dehydration-Induced Protein RD22-Like Protein [*Gossypium hirsutum*]", NCBI Database [Online], GenBank: AAL67991. 1, GenBank Accession No. AAL67991, Dec. 4, 2002.
Applicant-Initiated Interview Summary Dated Dec. 20, 2013 From the US Patent and Trademark Office Re. U.S. Appl. No. 13/125,047.
Official Action Dated Feb. 20, 2014 From the US Patent and Trademark Office Re. U.S. Appl. No. 12/834,106.
Hearing Notice Dated Apr. 17, 2014 From the Government of India, Patent Office, Intellectual Property Building Re. Application No. 2570/CHENP/2008.
Official Action Dated Jun. 2, 2014 From the US Patent and Trademark Office Re. U.S. Appl. No. 12/834,106.
Communication Pursuant to Article 94(3) EPC Dated Mar. 7, 2014 From the European Patent Office Re. Application No. 11154193.4.
European Search Report and the European Search Opinion Dated Mar. 11, 2014 From the European Patent Office Re. Application No. 11190921.4.
Applicant-Initiated Interview Summary Dated Aug. 6, 2012 From the US Patent and Trademark Office Re. U.S. Appl. No. 12/669,975.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
Applicant-Initiated Interview Summary Dated Nov. 4, 2014 From the US Patent and Trademark Office Re. U.S. Appl. No. 12/834,106.
Communication Pursuant to Article 94(3) EPC Dated Oct. 7, 2014 From the European Patent Office Re. Application No. 11154193.4.

\* cited by examiner

| Legend | Keyword | ESTs in Gene | ESTs in Production | Expected ESTs | Fold | p-value |
|---|---|---|---|---|---|---|
| | flower | 4 | 89278 | 10.8145 | 0.369873 | 0.997498 |
| | seedling + female flower | 4 | 9012 | 1.09165 | 3.66417 | 0.0234977 |
| | leaf | 1 | 35689 | 4.32312 | 0.231314 | 0.989277 |
| | ear leaf | 1 | 7960 | 1 | 1 | 0.622546 |
| | mix | 2 | 90046 | 10.9076 | 0.183359 | 0.999938 |
| | root | 37 | 36059 | 4.36794 | 8.47082 | 1.77636E-15 |
| | primary root system | 24 | 33886 | 4.10472 | 5.84693 | 7.81597E-14 |
| | root tip | 13 | 2173 | 1 | 13 | 2.22045E-15 |
| | seedling | 6 | 32466 | 3.93271 | 1.52567 | 0.19702 |
| | seedling + female flower | 4 | 9012 | 1.09165 | 3.66417 | 0.0234977 |
| | shoot | 1 | 16152 | 1.95654 | 0.511106 | 0.864469 |

Fig. 2a

| | callus | cambium | cell suspension | flower | germinating seed | leaf | mix | phloem | pod | root | seedling |
|---|---|---|---|---|---|---|---|---|---|---|---|
| cotton | | | | | | | | | | | 0.26 |
| grape | | | | 0.39 | | | | | | | |
| maize | | | | 0.07 | | 0.06 | 0.4 | | | 2.61 | 0.2 |
| poplar | | 2.8 | | | | | | 4.1 | | | |
| rice | | | | | 0.9 | 0.08 | | | | 5.25 | 1.24 |
| sorghum | 0.46 | | 2 | | | | | | | | 0.21 |
| soybean | | | | | | | | | 1 | 0.31 | 0.11 |
| tomato | 1.46 | | | | | | | | | | |
| TOTAL | 1.92 | 2.8 | 2 | 0.47 | 0.9 | 0.14 | 0.4 | 4.1 | 1 | 8.17 | 2.02 |

Fig. 2c

FUE 34 Evo Expression causes enhanced plant branching

US 8,962,915 B2

ISOLATED POLYPEPTIDES, POLYNUCLEOTIDES ENCODING SAME, TRANSGENIC PLANTS EXPRESSING SAME AND METHODS OF USING SAME

RELATED APPLICATIONS

This Application is a National Phase of PCT Patent Application No. PCT/IL2006/001223 having International filing date of Oct. 24, 2006, which claims the benefit of priority of U.S. Provisional Patent Application No. 60/729,181 filed on Oct. 24, 2005. The contents of the above Applications are all incorporated herein by reference.

This Application is also a Continuation-In-Part (CIP) of U.S. patent application Ser. No. 11/629,411 filed on Dec. 13, 2006, now U.S. Pat. No. 7,812,218, which is a National Phase of PCT Patent Application No. PCT/IL2005/000627 having International filing date of Jun. 14, 2005, which claims the benefit of priority of U.S. Provisional Patent Application No. 60/578,833 filed on Jun. 14, 2004.

CD-ROM CONTENT

The following lists the file content of the duplicate CD-ROMs, which are enclosed herewith and filed with the application. These files are incorporated herein by reference and thus form a part of the filed application. File information is provided as: File name/bite size/date of creation/machine format/operating system.
SEQUENCE LISTING.txt/2,977,792 bytes/Oct. 24, 2006/ Notepad/PC

FIELD AND BACKGROUND OF THE INVENTION

The present invention relates to isolated polypeptides, polynucleotides encoding same, transgenic plants expressing same and methods of using same. Specifically the present invention can be used to increase fertilizer use efficiency and stress resistance as well as biomass, vigor and yield of transgenic plants.

Fertilizers are the fuel behind the "green revolution", directly responsible for the exceptional increase in crop yields during the last 40 years. The dramatic rise in crop yields could never have occurred without a parallel increase in fertilizer use. However, in recent years there has been a growing concern with the environmental impact of fertilizer use, particularly nitrogen fertilizers, on water and atmospheric pollution. Limits on fertilizer use have been legislated in several countries, and further restrictions are expected in the future. Greater use of fertilizers will be necessary in the future to support food and fiber production for rapid population growth on limited land resources.

Fertilizer is often mentioned as the number one overhead expense in agriculture. Of the three macronutrients provided as main fertilizers [Nitrogen (N), Phosphate (P) and Potassium (K)], nitrogen is the only one that usually needs to be replenished every year, particularly for cereals, which comprise more than half of the cultivated areas worldwide.

A common approach to promoting plant growth has been, and continues to be, the use of nutrients (fertilizers), natural as well as synthetic. Synthetic nutrients usually provide a macronutrient in a plant-usable form, such as urea for example, and/or inorganic nitrates, phosphates, or the like compounds. While such nutrients may be applied, more or less, at the convenience of the farmer, and may be applied as often as deemed desirable, the overuse of synthetic nutrients and the inefficient use of synthetic nutrients are major factors responsible for environmental problems such as eutrophication of groundwater, nitrate pollution, phosphate pollution, and the like.

Nitrogen is an essential macronutrient for the plant, responsible for biosynthesis of amino and nucleic acids, prosthetic groups, plant hormones, plant chemical defenses, etc. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Nitrogenous fertilizer, which is usually supplied as ammonium nitrate, potassium nitrate, or urea, typically accounts for 40% of the costs associated with crops such as corn and wheat. It has been estimated that by 2050, more than 150 million tons of nitrogenous fertilizer will used worldwide annually. Increased use efficiency of nitrogen by plants should enable crops to be cultivated with lower fertilizer input, or alternatively on soils of poorer quality and would therefore have significant economic impact in both developed and developing agricultural systems. An overview of the undesirable effects of nitrogen fertilizer is presented by Byrnes, Fertilizer Research, 26, pp. 209-215 (1990). Although plants are able to take up organic nitrogen from the environment, the major part of the nitrogen utilized comes usually from the uptake of inorganic nitrogen in the form of ammonium ($NH_4^+$) and nitrate ($NO_3^-$) and its later conversion to organic nitrogen in a process known as assimilation.

The Nitrogen assimilation process begins with $NO_3^-$ being converted to $NH_4^+$ sequentially by the enzymes Nitrate Reductase (NR) and Nitrite Reductase (NiR). The nitrogen is then incorporated into Glutamate (Glu) by Glutamine Synthase (GS) to obtain Glutamine (Gln). The major pathway of nitrogen assimilation is the GS/GOGAT cycle (Glutamine Synthase/Glutamate-Oxoglutarate Amine Transferase). The remaining amino acids are synthesized from Gln, Glu and Asn by transamination.

Nitrogen (as amino acids or in the form of nitrates) is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant Nitrogen. The stored Nitrogen can then be redistributed from the leaves and stalk that served as storage compartments until grain formation.

There are three main parameters of efficiency used to define plant Nitrogen metabolism:

Nitrogen-uptake efficiency: is the amount of N in above-ground biomass (gr Nt) divided by the amount of N applied (gr/hectare);

Nitrogen utilization efficiency: is the Grain Yield (gr/plant) divided by the amount of N in above-ground biomass (gr Nt); and Nitrogen-use efficiency: is the Grain Yield (gr/plant) divided by the amount of N applied (gr/Ha).

The Nitrogen-uptake efficiency [the amount of N in above ground biomass (gr Nt)/N applied (gr/hectare)] is the total amount of nitrogen incorporated by the plant and is a function of the "uptake" (the plant's transport capacity), the metabolic efficiency of the assimilation process and the rate of plant size development, since the mass of stalk and leaves created during growth are the actual Nitrogen-storage organs. The fraction of the assimilated Nitrogen found in a shoot that is ultimately transferred to the grain (yield) is controlled enzymatically, and thus a potential site for transgenic manipulation. This parameter is, in effect, equal to the Nitrogen Utilization efficiency (NUE). Better grain-to-shoot N-partitioning most likely will improve yield and protein content of the grain.

Similarly, the same calculations of use and utilization efficiencies can be made for other macronutrients such as Phosphorous (P) and Potassium (K), which have a direct correlation with yield and general plant tolerance.

The NUE for the main crops ranges from 30-70% only, having a direct negative impact on input expenses for the farmer, due to the excess fertilizer applied, which quickly becomes an ecological burden. Thus, nitrate-containing wastes represent an environmental problem of global significance. Nitrate seepage in water causes eutrophication of lakes, rivers and seas (waters endangered because of algae growth that leads to hypoxia and destruction of marine fauna). Nitrate contamination in drinking water can cause methemoglobinemia, which is especially detrimental to infants and nursing mothers. In fact, the Farming Industry is considered as the largest nitrate polluter of surface and coastal waters and drinking water supplies.

Genetic improvement of Fertilizer Use Efficiency (FUE) in plants can be generated either via traditional breeding or via genetic engineering. However, to date, neither transgenic products nor classically bred enhanced FUE material have been released for commercial use. Among the reasons for this, the most important is that breeders select their elite lines under the most favorable fertilizer conditions, thus overlooking improvements in FUE (yield being the main driver of sales and not reduction in the input costs). Attempts at transgenic solutions for improved FUE are being carried out by companies such as Monsanto (see, for example, US Patent Applications 20020046419 to Choo, et al.; U.S. Pat. Appl. 2005010879 to Edgerton et al.; and U.S. Pat. Appl. 2006 0179511 to Chomet et al), Arcadia Biosciences and Biogemma.

Recently, a review summarizing attempts to improve FUE by transgenic means that have been undertaken by academic laboratories was published (Good A G et al. Trends Plant Sci. 2004 December; 9(12):597-605). Encouraging results were reported by Yanagisawa and coworkers (Proc Natl Acad Sci USA. 2004 May 18; 101(20):7833-8) who found that a genetically engineered increase in carbon skeleton production (2-Oxoglutarate, OG from the GS/GOGAT cycle) sustained growth of transgenic *Arabidopsis* under low nitrogen conditions. As many enzymes are involved in carbon skeleton production, the transgene was a key transcriptional factor (Dof1) that activated multiple genes involved in the pathway. Nitrogen content was higher in the *Arabidopsis* transgenic plants by approximately 30% under low nitrogen conditions. U.S. Pat. No. 6,084,153 to Good et al. discloses the use of a stress responsive promoter to control the expression of Alanine Amine Transferase (AlaAT). Good et al. further disclosed that transgenic canola plants improved drought and nitrogen deficiency tolerance when compared to control plants. However, neither the Dof1 constructs of Yanagisawa et al, nor the drought-induced AlaAT constructs of Good et al. have been evaluated in commercial lines, under true field conditions. Hence the economic relevance of the results is yet to be proven.

There is thus a widely recognized need for, and it would be highly advantageous to identify polynucleotides and polypeptides which improve fertilizer use/uptake efficiency in transgenic plants expressing same, which are devoid of the above limitations.

SUMMARY OF THE INVENTION

According to one aspect of the present invention there is provided a nucleic acid construct comprising a nucleic acid sequence at least 85% identical to a nucleotide sequence selected from the group consisting of SEQ ID NOs: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108 and 109 and a promoter sequence capable of directing transcription of the nucleic acid sequence in a host cell.

According to still further features in the described preferred embodiments the nucleic acid sequence is as set forth in SEQ ID NO: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108, 109, 219-767, 1317, 1318, 1319, 1320, 1321, 1322, 1323, 1324, 1325, 1326, 1327, 1328, 1329, 1330, 1331, 1332, 1333, 1334, 1335 or 1336.

According to another aspect of the present invention there is provided an isolated polypeptide, comprising an amino acid sequence at least 85% homologous to the amino acid sequence set forth in SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217 or 218.

According to yet another aspect of the present invention there is provided a plant cell comprising an exogenous polynucleotide which comprises a nucleic acid sequence encoding a polypeptide having an amino acid sequence at least 85% homologous to SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217 or 218.

According to still further features in the described preferred embodiments the plant cell forms a part of a plant.

According to still further features in the described preferred embodiments the amino acid sequence is as set forth in SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 768-1051, 1053-1098, 1100-1315 or 1316.

According to still another aspect of the present invention there is provided a method of increasing tolerance of a plant to a stress condition, comprising expressing within the plant an exogenous polynucleotide encoding a polypeptide having an amino acid sequence at least 85% homologous to SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 1341 or 1343, thereby increasing the tolerance of the plant to the stress condition.

According to an additional aspect of the present invention there is provided a method of increasing biomass, vigor and/or yield of a plant, comprising expressing within the plant an exogenous polynucleotide encoding a polypeptide having an amino acid sequence at least 85% homologous to SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 1341 or 1343, thereby increasing biomass, vigor and/or yield of the plant.

According to yet an additional aspect of the present invention there is provided a method of increasing fertilizer use efficiency and/or uptake of a plant comprising expressing within the plant an exogenous polynucleotide encoding a polypeptide having an amino acid sequence at least 85% homologous to SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 1341 or 1343, thereby increasing fertilizer use efficiency and/or uptake of the plant.

According to still further features in the described preferred embodiments the expressing is effected by:
 (a) transforming a cell of the plant with the exogenous polynucleotide;
 (b) generating a mature plant from the cell; and
 (c) cultivating the mature plant under conditions suitable for expressing the exogenous polynucleotide within the mature plant.

According to still further features in the described preferred embodiments the transforming is effected by introducing to the plant cell a nucleic acid construct including the exogenous polynucleotide and at least one promoter capable of directing transcription of the exogenous polynucleotide in the plant cell.

According to still further features in the described preferred embodiments the at least one promoter is a constitutive promoter.

According to further features in preferred embodiments of the invention described below, the promoter is a constitutive promoter.

According to still further features in the described preferred embodiments the constitutive promoter is CaMV 35S promoter.

According to still further features in the described preferred embodiments the promoter is an inducible promoter.

According to still further features in the described preferred embodiments the inducible promoter is an abiotic stress inducible promoter.

According to still further features in the described preferred embodiments the promoter is a tissue specific promoter.

According to still further features in the described preferred embodiments the tissue is a root tissue.

According to still further features in the described preferred embodiments the host cell is a plant cell.

According to still further features in the described preferred embodiments the plant cell forms a part of a dicotyledonous plant cell.

According to still further features in the described preferred embodiments the plant cell forms a part of a monocotyledonous plant cell.

According to still further features in the described preferred embodiments the stress condition is an abiotic stress.

According to still further features in the described preferred embodiments the abiotic stress is selected from the group consisting of salinity, drought, low temperature, high temperature, heavy metal toxicity, anaerobiosis, osmoticum, and nutrient deficiency.

According to still further features in the described preferred embodiments the nutrient is nitrogen.

According to still further features in the described preferred embodiments the plant is a dicotyledonous plant.

According to still further features in the described preferred embodiments the plant is a monocotyledonous plant.

According to still further features in the described preferred embodiments the polynucleotide comprises a nucleic acid sequence selected from the group consisting of SEQ ID NOs: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108, 109, 219-767, 1317, 1318, 1319, 1320, 1321, 1322, 1323, 1324, 1325, 1326, 1327, 1328, 1329, 1330, 1331, 1332, 1333, 1334, 1335, 1336, 1340 or 1342.

According to still further features in the described preferred embodiments the amino acid sequence is as set forth in SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 768-1051, 1053-1098, 1100-1316, 1341 or 1343.

According to still further features in the described preferred embodiments the conditions are abiotic stress conditions.

According to still further features in the described preferred embodiments the conditions are fertilizer deficiency conditions.

According to still an additional aspect of the present invention there is provided a method for irrigation comprising:
 (a) placing on or in a soil a dripping irrigation system so as to obtain irrigation holes distributed 20-40 cm from one another in the X and Y directions; and
 (b) continuously irrigating through each of said irrigation holes at an irrigation rate of 0.5-2 liter water per hour.

According to a further aspect of the present invention there is provided an irrigation system for mimicking drought conditions comprising:
 (i) a dripping irrigation system having irrigation holes distributed 20-40 cm from one another in the X and Y directions; and
 (ii) a water supply and control system for continuously irrigating through each of said irrigation holes 0.5-2 liter water per hour.

The present invention successfully addresses the shortcomings of the presently known configurations by providing polynucleotides and polypeptides which improve fertilizer use/uptake efficiency in transgenic plants expressing same.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The invention is herein described, by way of example only, with reference to the accompanying drawings. With specific reference now to the drawings in detail, it is stressed that the particulars shown are by way of example and for purposes of illustrative discussion of the preferred embodiments of the present invention only, and are presented in the cause of providing what is believed to be the most useful and readily understood description of the principles and conceptual aspects of the invention. In this regard, no attempt is made to show structural details of the invention in more detail than is necessary for a fundamental understanding of the invention, the description taken with the drawings making apparent to those skilled in the art how the several forms of the invention may be embodied in practice.

In the drawings:

Figure 1A:
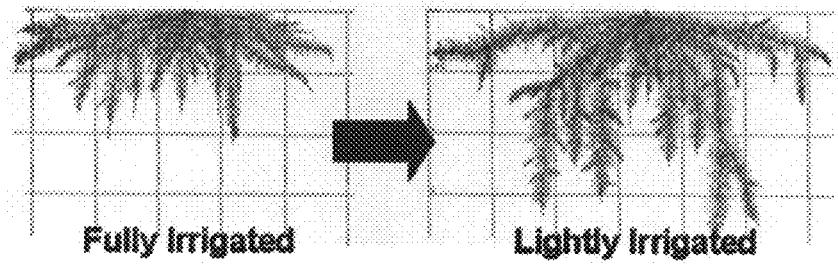

FIG. 1A is a schematic illustration describing the development of the plant root system in drought. Scarce soil humidity induces the formation of a deeper root system. The drawing is adapted from J E Weaver [Root Development of Field Crops. McGraw Hill Inc., New York, 291 p. (1926)].

Figure 1B:
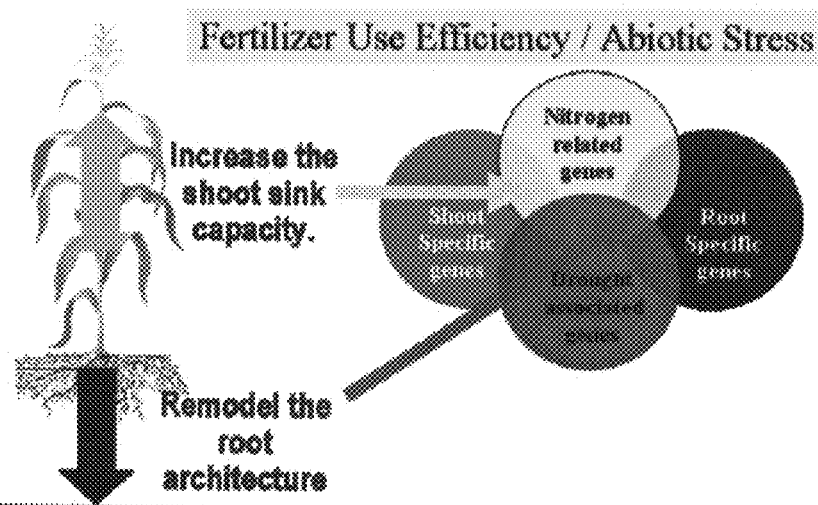

FIG. 1B is a schematic representation of the biological strategies chosen to improve the NUE trait and the translation of the strategies to the queries performed during computational data mining.

FIGS. 2A-D show digital expression of FUE_1.

FIGS. 3A-D are graphs showing expression of control genes (Nitrogen transporters and Glutamine synthase) as a function of nitrogen content in the soil. Plants were grown in 10 liter pots with increasing concentrations of either $NH_4NO_3$ (at 0.005, 0.05, 0.5 and 5 mM) or $KNO_3$ (at 0.01, 0.1, 1 or 5 mM). Plants were grown for approximately 30 days and tissues were snap frozen in liquid nitrogen. RNA was extracted from the tissues and later treated with DNAse. RNA was reverse-transcribed and used for quantification assays using Real Time PCR. For normalization, the expression at each point was divided by the geometric mean of the expression of four housekeeping as described in Example 2. The results shown are the ratio between the normalized expression and the expression levels measured at the highest concentration checked (5 mM $NH_4NO_3$ or 5 mM $KNO_3$).

FIGS. 4A-K are graphs showing correlated expression of polynucleotide sequences of the present invention with nitrogen availability.

FIGS. 5A-E are graphs showing inversely correlated expression of polynucleotide sequences of the present invention with nitrogen availability.

Figure 6:
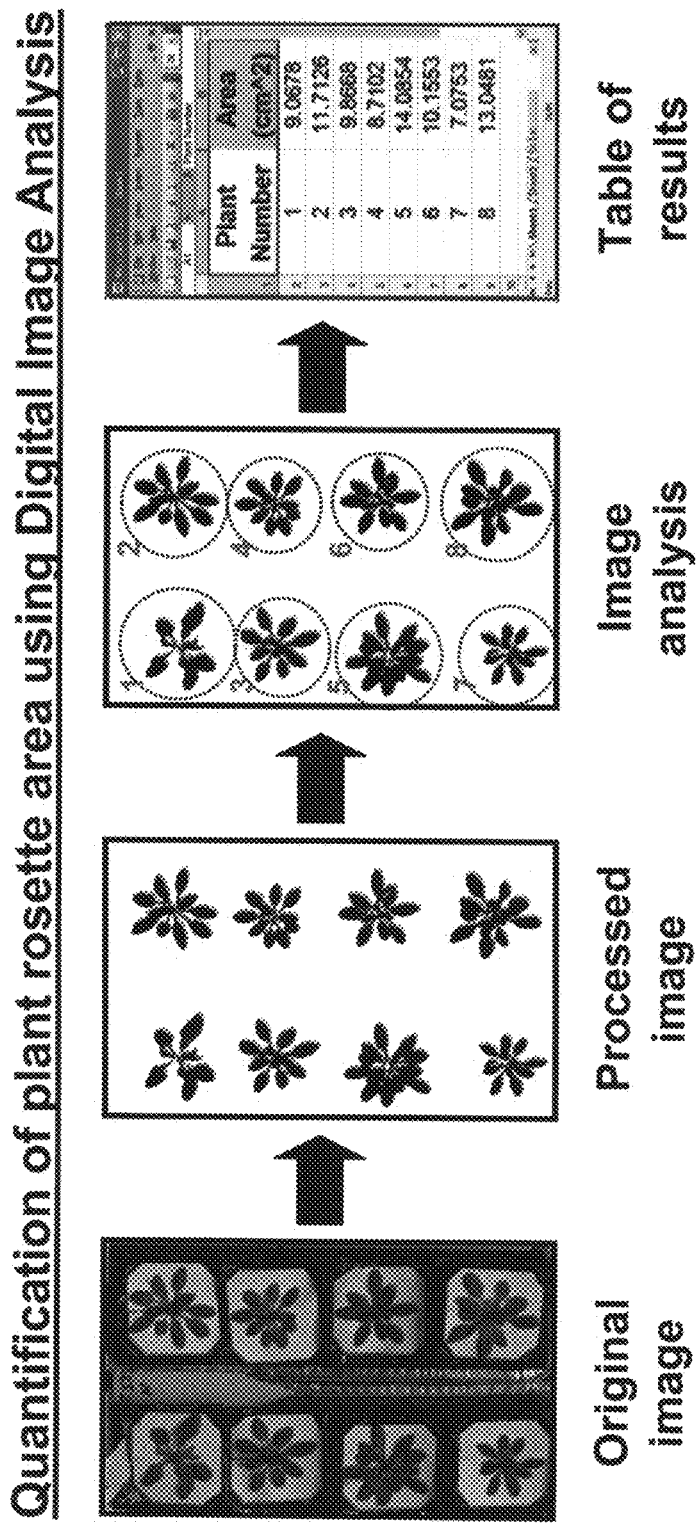

FIG. 6 is a schematic stepwise representation of the technology used for plant rosette area quantitation from digital images. The processing step filters the green parts of the individual plants. After designation of individual ROIs (Region of Interest) the area covered by the rosette area is calculated and exported to a worksheet.

Figure 7A:
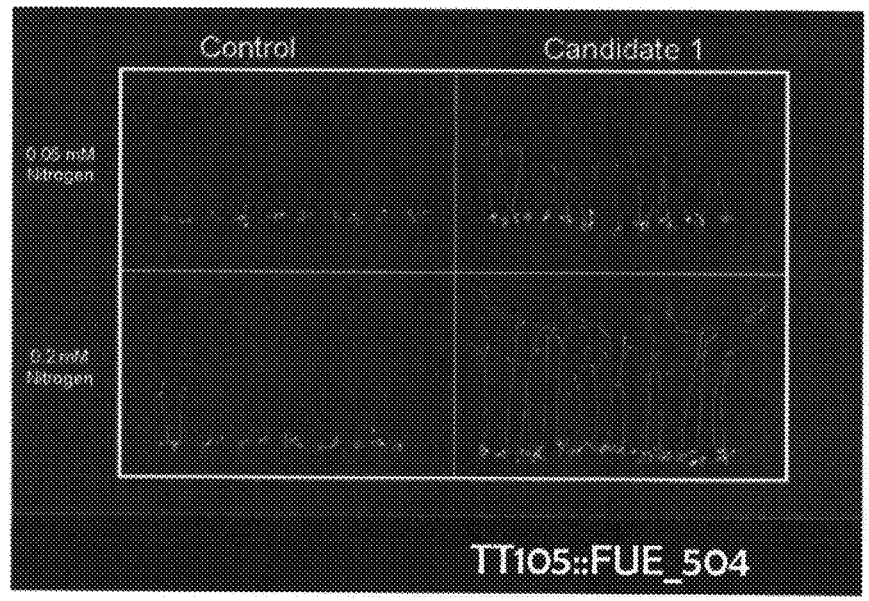
Figure 7B:
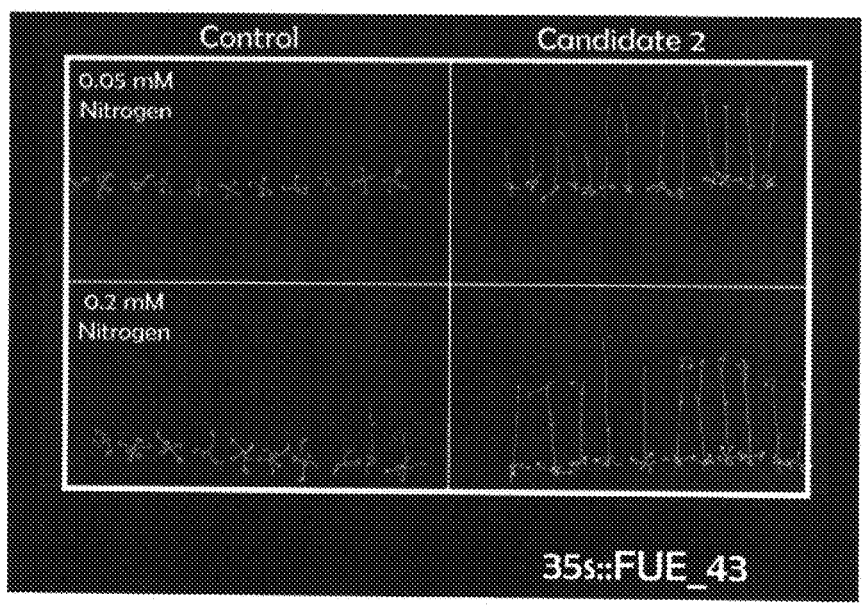

FIGS. 7A-B are photographs showing the ability of polynucleotides of the present invention to increase nitrogen use efficiency. FIG. 7A transgenic—T1 plants expressing FUE_504 (SEQ ID NO: 108) under the TT105 promoter. FIG. 7B one representative transgenic event expressing FUE_43 (SEQ ID NO: 70) under the 35S promoter. Plants were grown at very limiting nitrogen conditions (0.05 and 0.2 mM combined inorganic nitrogen). Control plants (expressing a reporter gene under the same promoter or non-transgenic plants) were treated similarly. The notorious differences in plantlet size are translated into significant differences in the measured fresh weight of the plantlets.

Figure 8:

FIG. 8 is a photograph showing transgenic plants from three independent transgenic events expressing FUE_34_Evo (SEQ ID NO: 54). The plant shows impressive branching at every node as determined by a triple blind assay. The root system from the plants was also highly branched and compact (not shown).

Figure 9:

FIG. 9 shows five independent transgenic events of plants expressing FUE_40 (also termed FUE6/40, SEQ ID NO: 11). It is clearly notable that the flowering stem is unusually upright and stiff. In addition, an unusually high number of siliques can be counted. As a result, transgenic plants expressing FUE_40 are remarkably prolific.

Figure 10:
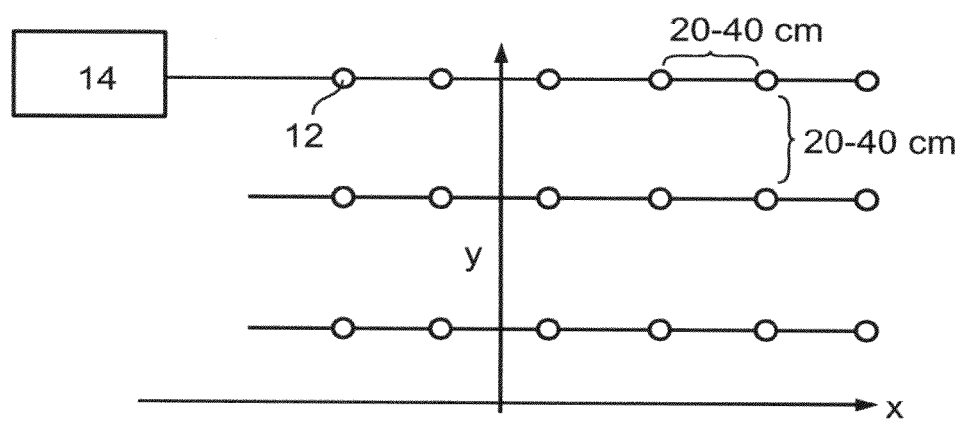

FIG. 10 a scheme of an irrigation system in accordance with the teachings of the present invention.

DESCRIPTION OF THE PREFERRED EMBODIMENTS

The present invention is of isolated polypeptides, polynucleotides encoding same, transgenic plants expressing same and methods of using same. Specifically the present invention can be used to increase fertilizer use efficiency and stress resistance as well as biomass, vigor and yield of transgenic plants.

The principles and operation of the present invention may be better understood with reference to the drawings and accompanying descriptions.

Before explaining at least one embodiment of the invention in detail, it is to be understood that the invention is not limited in its application to the details set forth in the following description or exemplified by the Examples. The invention is capable of other embodiments or of being practiced or carried out in various ways. Also, it is to be understood that the phraseology and terminology employed herein is for the purpose of description and should not be regarded as limiting.

As the cost of Nitrogen (N) fertilizer increases and profit of crop plants production is put as risk, scientists are challenged to develop strategies that improve N use efficiency (NUE). Thus, under or over-fertilization results in a loss of profit. Lower rates of N applied result in reduced biomass as may be evidenced by reduced tillering, size, poor grain fill, reduced yields and low amino acid and protein content. Alternatively, over application of nitrogen can result in reduced yield, higher input cost and increased risk to the environment.

While reducing the present invention to practice, the present inventors uncovered through laborious bioinformatic analyses and experimentation, polynucleotide sequences and polypeptides encoded therefrom which can be used to generate transgenic plants with improved fertilizer use efficiency, stress tolerance, nutritional value (e.g., amino acids and protein content), biomass, yield and/or vigor.

As is illustrated hereinbelow and in the examples section which follows, maize polynucleotide sequences were selected based on several criteria (see Example 1 of the Examples section which follows). These included high levels of calculated digital expression at the root tips especially in water stressed roots (e.g., drought). A secondary filter for the above polynucleotide sequences was based on the digital expression of their orthologous sequences (i.e., dicotyledon plants or other monocotyledons species). Orthologous genes showing similar digital expression as the maize genes (e.g., root libraries of stress treated plants subjected) were selected. Data mining and annotation tools were used to filter genes which may have broad effects on cell metabolism. For example genes which can modify root architecture, increase nitrogen storage capacity, improve nitrogen assimilation process, and enhance the stay-green trait were selected. Those genes were finally selected for molecular validation (see Examples 3 and 9). A schematic representation of the computational filters applied to identify the polynucleotide sequences of the present invention is presented in FIG. 1B and it is provided for illustration only.

Sequences thus identified were experimentally validated. As shown in Examples 6-11 transgenic plants expressing the nucleic acid sequences of the present invention were shown to have increased fertilizer use/uptake efficiency, tolerance to abiotic stress, biomass and yield. These results strongly support the robustness of the methodology of the present invention and substantiate the use of these genes in agriculture.

Thus, according to one aspect of the present invention, there is provided a nucleic acid construct comprising a nucleic acid sequence at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% identical to a nucleotide sequence selected from the group consisting of SEQ ID NO: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108, 109, 1340 and 1342.

Nucleic acid sequences may encode polypeptide sequences comprising an amino acid sequence at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to SEQ ID NO 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 1341 or 1343.

Homology (e.g., percent homology) can be determined using any homology comparison software, including for example, the BlastP software of the National Center of Biotechnology Information (NCBI) such as by using default parameters.

Identity (e.g., percent homology) can be determined using any homology comparison software, including for example, the BlastN software of the National Center of Biotechnology Information (NCBI) such as by using default parameters.

According to one preferred embodiment of this aspect of the present invention the isolated polynucleotide is as set forth is SEQ ID NO: 68, 1, 4, 5, 8, 9, 11, 13, 16, 19, 20, 23, 24, 27, 30, 32, 37, 42, 49, 50, 51, 53, 54, 55, 56, 57, 58, 64, 69, 70, 73, 77, 78, 79, 80, 84, 86, 87, 93, 94, 98, 101, 102, 103, 104, 105, 106, 107, 108, 109, 219-767, 1317, 1318, 1319, 1320, 1321, 1322, 1323, 1324, 1325, 1326, 1327, 1328, 1329, 1330, 1331, 1332, 1333, 1334, 1335 or 1336.

A nucleic acid sequence (also termed herein as isolated polynucleotide) of the present invention refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences of the polypeptides of the present invention may be optimized for plant expression. Such optimized sequences are provided in SEQ ID NOs: 1317, 1319, 1320, 1321, 1322, 1324, 1325, 1326, 1327, 1328, 1329, 1330, 1331, 1332, 1333, 1334, 1335 and 1336. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1SDCU=n=1N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage. Database through the NIAS (National Institute of Agrobiological Sciences) DNA bank in Japan (Hypertext Transfer Protocol:// World Wide Web (dot) kazusa (dot) or (dot) jp/codon/). The Codon Usage Database contains codon usage tables for a number of different species, with each codon usage table having been statistically determined based on the data present in Genbank.

By using the above tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the present invention encompasses nucleic acid sequences described hereinabove; fragments thereof, sequences hybridizable therewith, sequences homologous thereto, sequences orthologous thereto, sequences encoding similar polypeptides with different codon usage, altered sequences characterized by mutations, such as deletion, insertion or substitution of one or more nucleotides, either naturally occurring or man induced, either randomly or in a targeted fashion.

Nucleic acid sequences of the present invention may encode previously uncharacterized polypeptides Thus the present invention provides a polypeptide having an amino acid sequence at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 1341 or 1343.

According to an embodiment of this aspect of the present invention the isolated polypeptide comprises an amino acid sequence selected from the group consisting of 177, 110, 113, 114, 117, 118, 120, 122, 125, 128, 129, 132, 133, 136, 139, 141, 146, 151, 158, 159, 160, 162, 163, 164, 165, 166, 167, 173, 178, 179, 182, 186, 187, 188, 189, 193, 195, 196, 202, 203, 207, 210, 211, 212, 213, 214, 215, 216, 217, 218, 768-1051, 1053-1098, 1100-1315, 1316, 1341 or 1343.

The present invention also encompasses sequences homologous and orthologous to the above mentioned polypeptides, fragments of the above described polypeptides and polypeptides having mutations, such as deletions, insertions or substitutions of one or more amino acids, either naturally occurring or man induced, either randomly or in a targeted fashion.

Polynucleotides and polypeptides of the present invention are used for plant expression.

The term "plant" as used herein encompasses whole plants, ancestors and progeny of the plants and plant parts, including seeds, shoots, stems, roots (including tubers), and plant cells, tissues and organs. The term "plant" also therefore encompasses suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants which are of commercial value, including a fodder or forage legume, ornamental plant, food crop, tree, or shrub selected from the following non-limiting list comprising Acacia spp., Acer spp., Actinidia spp., Aesculus spp., Agathis australis, Albizia amara, Alsophila tricolor, Andropogon spp., Arachis spp, Areca catechu, Astelia fragrans, Astragalus cicer, Baikiaea plurijuga, Betula spp., Brassica spp., Bruguiera gymnorrhiza, Burkea africana, Butea frondosa, Cadaba farinosa, Calliandra spp, Camella sinensis, Canna indica, Capsicum spp., Cassia spp., Centroema pubescens, Chaenomeles spp., Cinnamomum cassia, Coffea arabica, Colophospermum mopane, Coronillia varia, Cotoneaster serotina, Crataegus spp., Cucumis spp., Cupressus spp., Cyathea dealbata, Cydonia oblonga, Ciyptomeria laponica, Cymbopogon spp., Cynthea dealbata, Cydonia oblonga, Dalbergia monetaria, Davalila divaricata, Desmodium spp., Dicksonia squarosa, Diheteropogon amplectens, Dioclea spp, Dolichos spp., Doiycnium rectum, Echinochloa pyramidalis, Ehrartia spp., Eleusine coracana, Era grestis spp., Erythrina spp., Eucalyptus spp, Euclea schimpen Eulalia villosa, Fagopyrum spp., Felloa sellowiana, Fragaria spp., Flemingia spp, Freycinetia banksii, Geranium thunbergi, Ginkgo biloba, Glycine javanica, Gliricidia spp, Gossypium hirsutum, Gre villea spp., Guibourtia coleosperma, Hedysarum spp., Hemarthia altissima, Heteropogon con tortus, Hordeum vulgare, Hyparrhenia rufa, Hypericum erectum, Hyperthelia dissoluta, Indigo incarnata, Iris spp., Jatropha curcas, Leptarrhena pyrolifolia, Lespediza spp., Lettuca spp., Leucaena leucocephala, Loudetia simplex, Lotonus bainesi, Lotus spp., Macrotyloma axifiare, Malus spp., Manihot esculenta, Medicago sativa, Metasequoia glyptostroboides, Musa sapientum, Nicotianum spp., Onobtychis spp., Ornithopus spp., Oryza spp., Peltophorum african urn, Pennisetum spp., Persea gratissima, Petunia spp., Phaseolus spp., Phoenix canariensis, Phormium cookianum, Photinia spp., Picea glauca, Pinus spp., Pisum sativum, Podocarpus totara, Pogonarthria flecki, Pogonarthria squarrosa, Populus spp., Prosopis cineraria, Pseudotsuga menziesi, Pterolobium stellatum, Pyrus communis, Quercus spp., Rhaphiolepsis umbellata, Rhopalostylis sapida, Rhu.s natalensis, Ribes grossularia, Ribes spp., Robinia pseudoacacia, Rosa spp., Rub us spp., Salix spp., Schyzachyrium sanguineurn, Sciadopitys verticillata, Sequoia sempen'irens, Sequoiadendron giganteum, Sorghum bicolor, Spinacia spp., Sporobolus fimbriatus, Stiburus alopecuroides, Stylosanthos humilis, Tadehagi spp, Taxodium distichum, Themeda triandra, Trifollum spp., Triticum spp., Tsuga heterophylla, Vaccinium spp., Vicia spp., Vitis vinifera, Watsonia pyramidata, Zantedeschia aethiopica, Zea mays, amaranth, artichoke, asparagus, broccoli, Brussels sprouts, cabbage, canola, carrot, cauliflower, celery, collard greens, flax, kale, lentil, ollseed rape, okra, onion, potato, rice, soybean, straw, sugar beet, sugar cane, sunflower, tomato, squash tea, trees. Alternatively algae and other non-Viridiplantae can be used.

Expressing the exogenous polynucleotide of the present invention within the plant can be effected by transforming one or more cells of the plant with the exogenous polynucleotide, followed by generating a mature plant from the transformed cells and cultivating the mature plant under conditions suitable for expressing the exogenous polynucleotide within the mature plant.

Preferably, the transformation is effected by introducing to the plant cell a nucleic acid construct which includes the exogenous polynucleotide of the present invention and at least one promoter capable of directing transcription of the exogenous polynucleotide in the plant cell. Further details of suitable transformation approaches are provided hereinbelow.

As used herein, the term "promoter" refers to a region of DNA which lies upstream of the transcriptional initiation site of a gene to which RNA polymerase binds to initiate transcription of RNA. The promoter controls where (e.g., which portion of a plant, which organ within an animal, etc.) and/or when (e.g., which stage or condition in the lifetime of an organism) the gene is expressed.

Any suitable promoter sequence can be used by the nucleic acid construct of the present invention. The following types of promoters are non-limiting examples of promoters used to over-express the selected genes: general promoters, root specific promoters, root-tips specific promoters, drought-induced root promoters, biotic stress-induced promoters, abiotic stress-induced promoters, nitrogen induced promoters, ammonium or nitrate induced promoters, phosphate fertilizer-induced promoters, leaf specific promoters, inducible promoters, constitutive promoters, promoters with two or more of the characteristics described above, or other novel promoters.

Choice of the promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. Measures should be taken, however, to select a promoter which will mediate desirable expression levels of the transgene so as to avoid reallocating excessive energetic resources which may affect final yield, strength, mass and lodging and incidence of foliar pathogens. This should also be viewed from an economic perspective.

Suitable constitutive promoters include, for example, CaMV 35S promoter (SEQ ID NO: 1337; Odell et al., Nature 313:810-812, 1985); *Arabidopsis* At6669 promoter (SEQ ID NO: 1514, PCT No WO2004/104162); TT105 (SEQ ID NO: 1339, PCT NO.: WO2004/081173) maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); and Synthetic Super MAS (Ni et al., The Plant Journal 7: 661-76, 1995). Other constitutive promoters include those in U.S. Pat. Nos. 5,659,026; 5,608,149; 5,608,144; 5,604,121; 5,569,597: 5,466,785; 5,399,680; 5,268,463; and 5,608,142.

Suitable tissue-specific promoters include, but not limited to, leaf-specific promoters such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993. Especially preferred are root promoters such as the ROOTP promoter [SEQ ID NO: 1338; Upstream region of the gene ATXTH19 (AT4G30290, Xyloglucan endotransglucosylase/hydrolase 19, described in Vissenberg K, et al. Plant Cell Physiol. 2005 January; 46(1):192-200].

A variety of plant gene promoters are known to regulate gene expression in response to environmental, hormonal, chemical, developmental signals, and in a tissue-active manner. Examples of seed-specific promoters (such as the napin, phaseolin or DC3 promoter described in U.S. Pat. No. 5,773,697), fruit-specific promoters that are active during fruit ripening, such as the dru 1 promoter (U.S. Pat. No. 5,783,393), or the 2A11 promoter (U.S. Pat. No. 4,943,674) and the tomato polygalacturonase promoter (Bird et al. (1988) Plant Mol. Biol. 11: 651-662), root-specific promoters, such as ARSK1, and those disclosed in U.S. Pat. Nos. 5,618,988, 5,837,848 and 5,905,186, epidermis-specific promoters, including CUT1 (Kunst et al. (1999) Biochem. Soc. Tians. 28: 651-654), pollen-active promoters such as PTA29, PTA26 and PTA 13 (U.S. Pat. No. 5,792,929), promoters active in vascular tissue (Ringli and Keller (1998) Plant Mol. Biol. 37: 977-988), flower-specific (Kaiser et al. (1995) Plant Mol. Biol. 28: 231-243), pollen (Baerson et al. (1994) Plant Mol. Biol. 26: 1947-1959), carpels (Ohl et al. (1990) Plant Cell 2: 837-848), pollen and ovules (Baerson et al. (1993) Plant Mol. Biol. 22: 255-267), auxin-inducible promoters (such as that described in van der Kop et al. (1999) Plant Mol. Biol. 39: 979-990 or Baumann et al. (1999) Plant Cell 11: 323-334), cytokinin-inducible promoter (Guevara-Garcia (1998) Plant Mol. Biol. 38: 743-753), promoters responsive to gibberellin (Shi et al. (1998) Plant Mol. Biol. 38: 1053-1060, Willmott et al. (1998) Plant Mol. Biol. 38: 817-825) and the like. Additional promoters are those that elicit expression in response to heat (Ainley et al. (1993) Plant Mol. Biol. 22: 13-23), light (e.g., the pea rbcS-3A promoter, described in Kuhlemeier et al. (1989) Plant Cell 1: 471-478, and the maize rbcS promoter, described in Schaffier and Sheen (1991) Plant Cell 3: 997-1012); wounding (e.g., wun1, described in Siebertz et al. (1989) Plant Cell 1: 961-968), pathogens (such as the PR-1 promoter described in Buchel et al. (1999) Plant Mol. Biol. 40: 387-396, and the PDF1.2 promoter described in Manners et al. (1998) Plant Mol. Biol. 38: 1071-1080), and chemicals such as methyl jasmonate or salicylic acid (Gatz (1997) Annu. Rev. Plant Physiol. Plant Mol. Biol. 48: 89-108). In addition, the timing of the expression can be controlled by using promoters such as those acting at senescence (Gan and Amasino (1995) Science 270: 1986-1988); or late seed development (Odell et al. (1994) Plant Physiol. 106: 447-458).

Other examples of promoters are a SUC2 promoter (Truernit and Sauer, Planta. (1995) 196:564-70), and a stress-inducible promoter such as RD29A (Yamaguchi-Shinozaki and Shinozaki K. Plant Cell (1994) 6:251-264), promoters fro the PlantProm database (Shahmuradov et al. Nucleic Acids Res. (2003) 31:114-7), the rice CatB promoter (Iwamoto et al. Plant Physiol Biochem. (2004) 42:241-9), the root specific and phosphate-deficiency inducible barley promoters of the phosphate transporter gene family (HvPht1;1 and HvPht1;2) (Schunmann et al. (2004); 55:855-65), tissue specific and constitutive promoters illustrated in patent No: WO2004/081173, in patent No: U.S. Pat. No. 5,633,363, in patent No: WO 2000/15662, in patent No: WO 2004/013169, in patent No: US 2005/010974, in patent No: WO 2005/035770, in patent No: US 2001/0047525, in patent No: U.S. Pat. No. 5,837,848, in patent No: U.S. Pat. No. 6,018,099, etc.

The nucleic acid construct of the present invention preferably further includes an appropriate selectable marker and/or an origin of replication. Preferably, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of the present invention can be utilized to stably or transiently transform plant cells. In stable transformation, the exogenous polynucleotide of the present invention is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

Preferably, mature transformed plants generated as described above are further selected for the trait of interest (e.g., improved FUE, stress tolerance etc.). Examples of such screening assays are provided hereinbelow and in the Examples section which follows. Thus, for example, transgenic plants may be screened for improved nutritional value (e.g., improved oil, amino acids and/or protein content, as well as N content per se) under normal or stress conditions as will be further described hereinbelow. Alternatively or additionally, transformed and non-transformed (wild type) plants are exposed to an abiotic stress condition, such as water depravation, suboptimal temperature, nutrient deficiency, or preferably a salt stress condition. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium (e.g., MS medium). Since different plants vary considerably in their tolerance to salinity, the salt concentration in the irrigation water, growth solution, or growth medium is preferably adjusted according to the specific characteristics of the specific plant cultivar or variety, so as to inflict a mild or moderate effect on the physiology and/or morphology of the plants (for guidelines as to appropriate concentration please see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein). Following exposure to the stress condition the plants are frequently monitored until substantial physiological and/or morphological effects appear in wild type plants. Subsequently, transformed plants not exhibiting substantial physiological and/or morphological effects, or exhibiting higher biomass than wild-type plants, are identified as abiotic stress tolerant plants.

Although stable transformation is presently preferred, transient transformation of leaf cells, meristematic cells or the whole plant is also envisaged by the present invention.

Transient transformation can be effected by any of the direct DNA transfer methods described above or by viral infection using modified plant viruses.

Viruses that have been shown to be useful for the transformation of plant hosts include CaMV, TMV and BV. Transformation of plants using plant viruses is described in U.S. Pat. No. 4,855,237 (BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants, is described in WO 87/06261.

Preferably, the virus of the present invention is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; and Takamatsu et al. FEBS Letters (1990) 269:73-76.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

Construction of plant RNA viruses for the introduction and expression in plants of non-viral exogenous polynucleotide sequences such as those included in the construct of the present invention is demonstrated by the above references as well as in U.S. Pat. No. 5,316,931.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols:

From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since the traits of the present invention (e.g., NUE and abiotic stress tolerance) in plants can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior NUE, tolerance, biomass and/or yield.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic message including all the different exogenous polynucleotide sequences. To enable co-translation of the different polypeptides encoded by the polycistronic message, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides.

Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior traits such as NUE, abiotic stress tolerance and/or biomass, using conventional plant breeding techniques.

As mentioned hereinabove, transgenic plants of the present invention can be used for improving myriad of commercially desired traits which are all interrelated as is discussed hereinbelow.

As used herein the term "trait" refers to a characteristic or quality of a plant which may overall (either directly or indirectly) improve the commercial value of the plant.

As used herein the term "improving" or "increasing" refers to improving or increasing the trait of the transgenic plant of the present invention by at least about 2% more, 5% more, 10% more, 20% more, 30% more, 40% more, 50% more, 60% more, 70% more, 80% more, 90% or more than that of the non-transgenic plant (e.g., mock transfected, or naïve).

The following are illustrative examples of traits which can be improved using the polynucleotides or polypeptides of the present invention.

Fertilizer use efficiency—Although the following will be more elaborated regarding Nitrogen (N) Use Efficiency (NUE) it is to be understood that the present invention envisages increasing/improving the overall fertilizer use efficiency of all minerals and organic moieties absorbed from the soil, such as phosphates (PUE) and potassium (KUE) by the transgenic plants of the present invention.

The efficiency by which N is used by the plant is affected among other things by both N uptake efficiency and N utilization efficiency. The ratio of the amount of N uptake by the plant (or N content, kg N) over the amount of N supplied/applied (kg $N_S$) is an uptake efficiency (kg N $kg^{-1}$ $N_S$), while the grain yield (kg grain) to N uptake (kg N) ratio is N utilization efficiency (NUE, kg grain $kg^{-1}$ N). See Moll 1982 Analysis and interpretation of factors which contribute to efficiency of nitrogen utilization. Argon. J. 74:562-564. NUE is also affected by N losses through ammonia volatilization, nitrification-denitrification, leaching and runoff which decrease the availability of N to the plant.

The present inventors realized that genes which alter root architecture can be used to improve NUE. The rationale is to position a higher fraction of the roots in deeper soil layers where the fertilizer is leached or increasing the soil coverage where the fertilizer is concentrated. This strategy was already proven successful with Phosphorous deficiency in soybean (Miller, C R, I Ochoa, K L Nielsen, D Beck, J P Lynch. 2003. *Genetic variation for adventitious rooting in response to low phosphorus availability: potential utility for phosphorus acquisition from stratified soils*. Functional Plant Biology 30:973-985) and maize (Zhu, J, J P Lynch. 2004. *The contribution of lateral rooting to phosphorus acquisition efficiency in maize (Zea mays L.) seedlings*. Functional Plant Biology 31:949-958) and other crop plants. Root morphogenesis is dramatically affected by development programming as well as by environmental conditions. Drought leads to a pronounced downward development of the root structure to reach water located in deeper soil layers (see FIG. 1A) while local nutrient availability causes a local root outgrowth increasing the total absorptive surface of the root system. The development of root systems is usually highly asymmetric and reflects the ability of roots to adjust their growth and development to environmental factors. Genes and gene expression control the developmental changes, as is the case of ANR1: a putative transcription factor with a role in $NO_3^-$ signaling. When ANR1 is down-regulated by antisense or co-suppression, the resulting transgenic lines are defective in their root response to localized supplies of $NO_3^-$ (Zhang, H., Forde, B. G. 1998, An *Arabidopsis* MADS box gene that controls nutrient-induced changes in root architecture, Science 270:407). Hence, altering expression of the polynucleotides of the present invention in transgenic plants may have desirable effects on root morphogenesis, some of them could positively affect NUE and abiotic/biotic stress tolerance and/or to enhance plant yield and vigor. Specific examples include FUE_7, FUE_16 and FUE_34_Evo.

Additionally selected are those which enhance intracellular storage reduce the cytosolic concentration, thereby reducing the energetic barrier for the membrane transporters responsible for the uptake of the different forms of the fertilizer. In this way, higher rates of fertilizer uptake can be obtained. Similarly, as expected from any enzymatic reaction or pathway, if the product of fertilizer assimilation is efficiently removed for the cellular milieu the enzymatic pathway building this product is expected to occur at accelerated rate leading to improved assimilation or use efficiency.

In yet another approach to improve FUE, a third group of genes was identified. Those genes are related to the biochemical pathways involved in the conversion of the inorganic fertilizer form to the organic material (assimilation process). Releasing bottlenecks in the assimilation process has granted promising effects on enhanced nutrients use efficiency, as in the case of the transcription factor Dof1 (Yanagisawa S d, Akiyama A, Kisaka H, Uchimiya H, Miwa T. Metabolic engineering with Dof1 transcription factor in plants: Improved nitrogen assimilation and growth under low-nitrogen conditions. Proc Natl Acad Sci USA. 2004 May 18; 101(20):7833-8). The genes found using this approach relieve the biochemical bottlenecks leading to enhanced fertilizer use efficiency. FUE_101 and FUE_102 comprise a transporter activity and therefore may be used to improve nutrient uptake.

Storage capacity—polynucleotide and polypeptide sequences of the present invention are directed to enhance the general storage capability of the plant. The capacity for grain production is predetermined by the plants ability to absorb and store mineral nitrogen in its early phases of development (Hirel et el. Plant Physiol, March 2001, Vol. 125, pp. 1258-1270). Therefore enhanced storage capacity in the form of nitrate or amino acids highly likely will increase the grain yield. This invention includes molecular mechanisms to improve the nitrogen or any metabolic nutrient storage capacity of the plant. Examples include, amino acids, protein, starch and oil, fiber, ash, chlorophyll and mineral content.

Plant protein content is directly related to the N concentration in the grain (see Mosse 1990 J. Agric. Food Chem. 38:18-24). This is highly valuable for improving the nutritional value of food. For example, children consuming high-protein (10%_milled rice showed improved growth compared with children consuming average-protein (6-7%) milled rice [Juliano (1993) Rice in Human Nutrition. IRRI and FAO, Rome]. Thus, transgenic plants displaying high efficiency in remobilizing N from vegetative parts to the edible part (e.g., grain) are highly valuable. Since the levels of nitrogen at flowering determine the grain yield, overexpression of the polynucleotide sequences of the present invention will improve the grain yield and/or enhance protein content of grain at the entire plant level. In addition, increased solute content of the plant prevents evaporation and water loss due to heat, drought, salinity, osmoticum, etc therefore providing a better plant tolerance to the above stresses. Overexpression of FUE_501, FUE_502, FUE_503, FUE_504 or FUE_49, FUE_51, FUE_52, FUE_53 or FUE_100 and FUE_101 are expected to increase the storage capacity of the tissues where they are expressed. This may lead to a stronger sink capacity, and to a better use of the fertilizer applied (particularly nitrogen) due to enhanced absorption from the soil. Since the levels of nitrogen at flowering determine the grain yield, it is expected that the overexpression of the above genes will also improve the grain yield and/or enhance protein content of grain and the entire plant protein level. In addition, increased solute content of the plant will prevent evaporation and water loss due to heat, drought, salinity, osmoticum, and the like thereby providing a better plant tolerance to the above stresses.

Delayed leaf senescence or "stay-green"—extends nutrient uptake longer into the plant cycle providing increased capacity to store nitrogen and to provide photosynthate during grain filling. If a plant has more green leaves at the period of pollination more nitrogen will be available for redistribution to the kernels causing an improvement in fertilizer use efficiency and probably grain yield. Some of the genes presented in this invention increase the "stay green" trait or exhibit enhanced growth (faster growth and/or bigger leaves and stalks) as a mechanism to improve fertilizer use efficiency, grain yield and overall stress tolerance of the plant.

Invertase is an enzyme that is known to delay senescence when expressed under a senescence-activated promoter (Balibrea Lara, et al. Plant Cell 16: 1276-1287, 2004). FUE_30 and FUE_31 have a predicted invertase activity and therefore can extend the stay-green characteristics of the plant and therefore increase the overall capacity to store nitrogen in plants for redistribution during grain filling.

Cytokinin is involved, among other processes, in the inhibition of leaf senescence. FUE_55 is a gene with a striking similarity to tRNA isopentenyltransferase, an important enzyme in the cytokinin metabolic pathway. Increased expression of FUE_55 in the roots or shoots will increase the levels of cytokinin leading to enhanced leaf expansion and cell duplication, delayed senescence, increased sink strength of the tissues, enhanced nitrogen utilization, etc.

Zeatin is a naturally occurring cytokinin. FUE_505 is a putative AP2 domain-containing transcription factor that based on microarray experiments it clusters tightly together with ARR genes (Arabidopsis response regulators) which mediate the response of the shoot to cytokinin. ARR genes are Zeatin responsive and are induced after nitrogen addition to nitrogen starved plants. FUE_505 co-regulation together with ARRs indicates a role in the cytokinin response. It is highly likely that constitutive expression of FUE_505 will delay leaf senescence and improve nitrogen utilization and plant growth due to continuous activation of the cytokinin response of the shoot.

Stress tolerance—Transgenic plants of the present invention are expected to exhibit tolerance to biotic and abiotic stress.

The phrase "stress" used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency (including also nutrient inaccessibility such as due to leaching), atmospheric pollution or UV irradiation. Biotic stress can be induced for example by pathogens which are found in the environment.

The phrase "stress tolerance" as used herein refers to the ability of a plant to endure an stress (abiotic) without suffering a substantial alteration in metabolism, growth, productivity and/or viability. Preferably, the genetically engineered plants of the present invention exhibit at least about 2% more, 5% more, 10% more, 20% more, 30% more, 40% more, 50% more, 60% more, 70% more, 80% more, 90% more or even higher tolerance to abiotic stress than non-transgenic plants.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. In a recent review, Zhu notes that "most studies on water stress signaling have focused on salt stress primarily because plant responses to salt and drought are closely related and the mechanisms overlap" (Zhu (2002) Ann. Rev. Plant Biol. 53: 247-273). Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

The ability of the transgenic plants of the present invention to endure stress is expected to affect plant biomass, vigor and yield. The opposite is also anticipated to present good results, essentially, improved biomass, vigor and/or yield is expected to improve the endurance of transgenic plants of the present invention to stress conditions.

As used herein the phrase "plant biomass" refers to the amount or quantity of tissue produced from the plant in a growing season, which could also determine or affect the plant yield or the yield per growing area.

As used herein the phrase "plant vigor" refers to the amount or quantity of tissue produced from the plant in a given time. Hence increase vigor could determine or affect the plant yield or the yield per growing time or growing area.

As used herein the phrase "plant yield" refers to the amount or quantity of tissue produced and harvested as the plant produced product. Hence increase yield could affect the economic benefit one can obtain from the plant in a certain growing time.

To analyze the effect of the transgene on plant physiology, one can assess overall yield and biomass, the tolerance of the plants to fertilizer deficiency and to abiotic stresses such as drought, salinity, cold and heat stresses, freezing, etc. Also of great importance is to assess whether the plant at any of its parts contains an increased content of protein, free amino acids, oil and any other metabolic compounds of value.

The following summarizes assays which may be used to qualify transgenic plants or transgenes of the present invention (further description of these and other assays are provided in the Examples section which follows).

Fertilizer use efficiency—To analyze whether the transgenic plants are more responsive to fertilizers, plants are grown in agar plates or pots with a limited amount of fertilizer. The plants are analyzed for their overall size, time to flowering, yield, protein content of shoot and/or grain. An example methodology of a test for fertilizer use efficiency is provided in the work by Yanagisawa et al (Proc Natl Acad Sci USA. 2004; 101:7833-8) in which seeds of transgenic *Arabidopsis* are checked for growth rates under limiting-nitrogen conditions (for example at 0.01 mM, 0.05 mM 0.15 mM, 0.3 mM, 1 mM, 3 mM Nitrogen in the form of nitrate or ammonium). The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, Phosphate or Potassium can be added at increasing concentrations. Again, the same parameters measured are the same as listed above. In this way, besides Nitrogen Use Efficiency (NUE), Phosphate Use Efficiency (PUE) and Potassium Use Efficiency (KUE) are assessed checking the ability of the transgenic plants to thrive under nutrient restraining conditions.

Nitrogen determination—The procedure for N concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of NaNO$_2$. The procedure is described in details in Samonte et al. 2006 Agron. J. 98:168-176.

Grain protein concentration—Grain protein content (g grain protein m$^{-2}$) is estimated as the product of the mass of grain N (g grain N m$^{-2}$) multiplied by the N/protein conversion ratio of k-5.13 (Mosse 1990, supra). The grain protein concentration is estimated as the ratio of grain protein content per unit mass of the grain (g grain protein kg$^{-1}$ grain).

Oil content—The amount of oil expressed as percentage of dry weight. Oil content is defined as the maximum amount of material (lipid) that can be removed from the seed by extraction with specific solvents (usually hexane or petroleum ether). Oil content is measured directly by grinding the seed and extracting the oil in a continuous extractor. Indirect oil content analysis can be carried out using either Nuclear Magnetic Resonance (NMR) Spectroscopy or Near Infrared (NI) Spectroscopy. The NMR technique measures the resonance energy absorbed by hydrogen atoms in the liquid state of the sample while NI utilizes the absorption of near infrared energy (1100-2500 nm) by the sample. While the precision of NIR methods is not as good as extraction methods, NMR methods give very accurate and precise results when calibrated carefully.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the candidate genes detailed above. Seeds from control *Arabidopsis* plants, or other transgenic plants overexpressing or silencing a polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants were re-watered after obtaining a significant fraction of the control plants displaying a severe wilting. Plants are ranked comparing to controls for each of two criteria: tolerance to the drought conditions and recovery (survival) following re-watering.

Salinity tolerance assay—transgenic plants with tolerance to high salt are expected to exhibit better germination, seedling vigor or growth in high salt. Plants differ in their tolerance to NaCl depending on their stage of development, therefore seed germination, seedling vigor, and plant growth responses are evaluated. A salinity tolerance test is taking plants at different developmental stages and irrigate them with increasing concentrations of NaCl (for example 50 mM, 100 mM, 200 mM, 400 mM) applied from the bottom and from above to ensure even dispersal of salt. Transgenic plants are compared to control plants in their external phenotypic appearance, degree of wilting, and overall success to reach maturity and yield progeny at concentrations inhibitory to control plants. Quantitative parameters of tolerance measured are, the average wet and dry weight, and the weight of the seeds yielded, the average seed size and the number of seeds produced per plant. Osmotic stress assays (including NaCl and mannitol assays) are conducted to determine if an osmotic stress phenotype was NaCl-specific or if it was a general osmotic stress related phenotype. Plants tolerant to osmotic stress could also have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, etc.

Heat stress tolerance—heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% Murashige-Skoog medium (MS)+vitamins.

Germination is checked also at unfavorable conditions such as cold (incubating at temperatures lower than 10° C. instead of 22° C.) or using seed imbibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

Methods of assaying plant vigor, yield and biomass are well known in the art (see Example 9 and Example 10).

The present invention is also valuable for breeding and ornamental purposes. It is thus envisaged that polynucleotides and polypeptide sequences of the present invention which are associated with root architecture (FUE_34_Evo, SEQ ID NO: 54, see also Example 11 and FIG. 8) may also be used to govern plant tillering and as such may be upregulated or downregulated to govern branching and tillering. Methods of downregulating gene expression in plants are well known in the art.

Thus, the present invention is of high agricultural value for promoting commercially desired traits in crop-plants.

As used herein the term "about" refers to ±10%.

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

EXAMPLES

Reference is now made to the following examples, which together with the above descriptions, illustrate the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Polynucleotide Identification and Gene Role Prediction Using Bioinformatics and Molecular Tools Polynucleotides, suitable for increasing FUE and/or abiotic or biotic stress tolerance were identified by in-depth analysis of RNA expression profiles, sequence similarities, gene annotations, biochemical pathways, DNA, ESTs, protein and expression databases, which are publicly available and used as input data to a series of proprietary computational algorithms that allow expert data mining.

Trait association was performed using accurate expression profiling by means of quantitative Real Time PCR, to correlate between the expression levels in different tissues and under specific growth conditions for elucidating the function of the expressed polynucleotide.

Materials and Methods

Identifying Polynucleotide Sequences Associated with Increased FUE

The present methodology is based on three stages described in the following examples, essentially the bioinformatic filtering, molecular analysis and in planta validation. Infra is a description of the bioinformatic algorithm.

A. Bioinformatic Filtering:

Clustering DNA sequences into gene clusters—The aim of EST (Expressed Sequence Tag) clustering is to incorporate all ESTs that share a transcript or gene parent to the same cluster. Typically, clustered ESTs are assembled into one or more consensus sequences (contigs) that reflect the transcript diversity, providing these contigs such that the information they contain most truly reflects the sampled biology. A gene cluster is fragmented, EST data and (if known) gene mRNA sequence data, consolidated, placed in correct context and indexed by gene such that all expressed data concerning a single gene is in a single index class, and each index class contains the information for only one gene (Burke et al, 1999, D2_cluster: A Validated Method for Clustering EST and Full-length cDNA Sequences. Genome Research, 9(11), 1135-1142). The Compugen LEADS™ platform (Hypertext Transfer Protocol://World Wide Web (dot) cgen (dot) com/research/Publications/LEADSwhitepaper.pdf) was used for the assembly.

Calculating the digital expression for all the gene clusters in several plant species—Digital expression, also known as electronic northern blot, compares occurrences of large number of random ESTs from non-normalized cDNA libraries. The variation in the relative frequency of those tags, stored in databases, is then used to elucidate the differential expression of the corresponding genes. Digital Northern data can be used to provide quantitative assessment of differential expression between different organs in the plant or at different physiological states (stress versus normal). This tool displays virtual expression profiles of genes based on the EST sequences forming the cluster. The tool can provide the expression profile of a cluster in terms of plant anatomy (i.e., in what tissues/organs is the gene expressed), developmental stage (i.e., the developmental stages at which a gene can be found) and profile of treatment (i.e., provides the physiological conditions under which a gene is expressed such as drought, cold, pathogen infection and the like). Given a random distribution of ESTs in the different clusters, the digital expression provides a probability value that describes the probability of a cluster having a total of N ESTs to contain X ESTs from a certain collection of libraries. For the probability calculations the following is taken into consideration: a) the number of ESTs in the cluster, b) the number of ESTs originating from a specific library or a group of related libraries, c) the overall number of ESTs available representing the species. In this way clusters with low probability values are highly enriched with ESTs from the group of libraries of interest indicating a specialized expression. In addition, a proprietary vocabulary (limited compendium of terms) is used that takes into consideration the annotation of each EST library and uses specific keywords to describe the experimental data associated with the sequences with regards to tissue type, treatment and developmental stages. The terms chosen from the proprietary vocabulary are combined with the calculated digital expression to build an expression profile for each specific gene, based on the source of the libraries that provide the sequences to the gene cluster. A statistic and graphic representation of this profile is built for the digital expression calculations. Because the annotations are from a controlled vocabulary, the entire database is dissected with specific keywords describing specific tissues, developmental stages or treatments.

Integrating all relevant data for each gene, including expression data from microarray experiments, digital expression, annotation, ontology, gene families, conserved motifs and the like—A proprietary tool that creates groups of orthologous genes from genomic databases from multiple plant species is used. In order to provide further support to the genes identified, orthologous genes or the orthologous group is tested as a whole to see involvement of the trait of interest according to the keywords that are most significant in their calculated digital expression.

Gene selection—This is done according to several biologically sound assumptions to query the database described above. Gene selection is done by filtering specific groups of genes using carefully selected criteria. The final set of genes should contain a limited number of genes, which one could handle in the following molecular analysis and transgenic experiments. The different criteria utilized herein are described with great detail for each gene below.

Gene selection for this invention takes into consideration several concepts widely accepted in plant science. Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption and assimilation processes. In this process, genes are triggered and activated causing the architectural change (Jose Lopez-Bucio et al, The role of nutrient availability in regulating root architecture, Current Opinion in Plant Biology 2003, 6:280-287). Engineering the expression of the triggered genes may cause the plant to exhibit the architectural changes and enhanced metabolism also under other conditions. Second, it is widely known that the plants usually respond to drought by creating a deeper root system that allows access to moisture located in deeper soil layers (Morgan, J. M., and A. G. Condon. 1986. Water use, grain yield, and osmoregulation in wheat. Aust. J. Plant Physiol. 13:523-532 and Yiwei Jiang and Bingru Huang, 2001, *Crop Science* 41:1168-1173). Triggering this effect will allow the plants to access nutrients located in deeper soil horizons particularly those readily dissolved in water like nitrates. Third, different abiotic stresses (e.g., drought, osmoticum, cold, heat, radiation, salinity, nutrient deficiencies, and the like) elicit their response using both: stress-specific as well as common stress pathways (Gabriela M. Pastori and Christine H. Foyer, Common Components, Networks, and Pathways of Cross-Tolerance to Stress, Plant Physiol, June 2002, Vol. 129, pp. 460-468). This provides the possibility to distinguish between the genes that are involved in each pathway.

The plant response to stress is costly in terms of energy as such affecting plant yield. Precise engineering of specific genes provides the ability to activate only partially a stress response without causing the concomitant loss in yield. Accordingly, several queries to distinguish the genes that are activated during the common and stress-specific responses were performed. Since some of the plant responses such as enhanced root system or superior storage capabilities are highly preferred also at optimal growing conditions, the present invention envisages to create modified plants with improved FUE that show in addition also enhanced response to other abiotic plant stresses that cause adverse effects on yield.

For the purpose of the identification FUE improving genes, 416899 EST and 23563 mRNA transcript sequences from Maize were extracted from Genbank release 145 (December 2004), cleaned by screening for vectors, low-complexity sequences and known repeats from public databases, and then clustered and assembled into contigs using Compugen's LEADS platform.

The EST libraries in Genbank 146 for Maize and other species such as Soybean, Tomato, Barley, Sorghum, Rice, Cotton, Wheat and *Arabidopsis* were examined and annotated using keywords describing the plant tissue used, the treatment applied to grow the plants and the developmental stage of the plants when the tissues were taken. A significance value was assigned to the frequency of ESTs in each contig from each EST library or set of libraries sharing the same annotation. The significance value was based on a statistical test that takes into account the number of ESTs from the given category in the contig, the number of these ESTs in the whole production, the size of the contig and the total number of ESTs in the production.

In addition Arabidopsis microarray experiments, freely available at the Nottingham Arabidopsis Stock Centre (NASC, Hypertext Transfer Protocol://affymetrix (dot) arabidopsis (dot) info/) comprising experiments describing anatomy, development and various stress experiments were integrated. To link the contigs of the LEADS Maize production to the corresponding cluster from other species orthologue finder algorithm was employed that uses among other filters, reciprocal BLAST analysis to identify the most similar gene in other plant species.

The following describes the parameters which were used for selecting each gene. Table 1 below associates internal identifiers (NUE_XXX or FUE_XXX which are interchangeably used) to SEQ ID Nos.

TABLE 1

| Internal Identifier | SEQ ID NO: (polynucleotide) | SEQ ID NO: (polypeptide) | Plant |
|---|---|---|---|
| FUE 1 | 1 | 110 | maize |
|  | 2 | 111 | rice |
|  | 3 | 112 | soybean |
| FUE 2 | 1318 | 113 | maize |
| FUE 3 | 5 | 114 | maize |
|  | 6 | 115 | barley |
|  | 7 | 116 | rice |
| FUE 4 | 8 | 117 | maize |
| FUE 5 | 9 | 118 | maize |
|  | 10 | 119 | rice |
| FUE 40 (6/40) | 11 | 120 | maize |
|  | 12 | 121 | sorghum |
| FUE 7 | 1323 | 122 | maize |
|  | 14 | 123 | sorghum |
|  | 15 | 124 | barley |
| FUE 8 | 1324 | 125 | maize |
|  | 17 | 126 | sorghum |
|  | 18 | 127 | rice |
| FUE 9 | 1325 | 128 | maize |
| FUE 10 | 20 | 129 | maize |
|  | 21 | 130 | soybean 1 |
|  | 22 | 131 | soybean 2 |
| FUE 11 | 23 | 132 | maize |
| FUE 12 | 1327 | 133 | maize |
|  | 25 | 134 | barley |
|  | 26 | 135 | sorghum |
| FUE 13 | 27 | 136 | maize |
|  | 28 | 137 | barley |
|  | 29 | 138 | rice |
| FUE 14 | 1329 | 139 | maize |
|  | 31 | 140 | barley |
| FUE 15 | 32 | 141 | maize |
|  | 33 | 142 | barley |
|  | 34 | 143 | rice |
|  | 35 | 144 | tomato |
|  | 36 | 145 | soybean 1 |

TABLE 1-continued

| Internal Identifier | SEQ ID NO: (polynucleotide) | SEQ ID NO: (polypeptide) | Plant |
|---|---|---|---|
| FUE 16 | 37 | 146 | maize |
|  | 38 | 147 | barley |
|  | 39 | 148 | rice |
|  | 40 | 149 | soybean |
|  | 41 | 150 | tomato |
| FUE 17 | 42 | 151 | maize |
|  | 43 | 152 | barley |
|  | 44 | 153 | sorghum |
|  | 45 | 154 | rice |
|  | 46 | 155 | soybean 1 |
|  | 47 | 156 | soybean 2 |
|  | 48 | 157 | tomato |
| FUE_30 | 49 | 158 | maize |
| FUE_31 | 50 | 159 | maize |
| FUE_32 | 389 | 160 | maize |
|  | 52 | 161 | wheat |
| FUE_33 | 53 | 162 | maize |
| FUE_34_evo | 54 | 163 | maize |
| FUE_34_Pat | 55 | 164 | maize |
| FUE_35 | 56 | 165 | maize |
| FUE_36 | 57 | 166 | maize |
| FUE_37 | 58 | 167 | maize |
|  | 59 | 168 | barley |
|  | 60 | 169 | wheat |
|  | 61 | 170 | sugarcane |
|  | 62 | 171 | rice |
|  | 63 | 172 | soybean |
| FUE_38 | 64 | 173 | maize |
|  | 65 | 174 | barley |
|  | 66 | 175 | sorghum |
|  | 67 | 176 | soybean |
| FUE_39 | 68 | 177 | maize |
| FUE_41 | 69 | 178 | maize |
| FUE_43 | 70 | 1186 | maize |
|  | 71 | 180 | rice |
|  | 72 | 181 | sorghum |
| FUE_44 | 73 | 182 | maize |
|  | 74 | 183 | soybean |
|  | 75 | 184 | barley |
|  | 76 | 185 | sorghum |
| FUE_45 | 77 | 186 | maize |
| FUE_46 | 673 | 1222 | maize |
| FUE_47 | 79 | 188 | maize |
| FUE_48 | 80 | 189 | maize |
|  | 81 | 190 | rice |
|  | 82 | 191 | barley |
|  | 83 | 192 | sorghum |
| FUE_49 | 1335 | 1243 | maize |
|  | 85 | 194 | sorghum |
| FUE_50 | 99 | 1248 | maize |
| FUE_51 | 87 | 196 | maize |
|  | 88 | 197 | sorghum |
|  | 89 | 198 | barley |
|  | 90 | 199 | barley 2 |
|  | 91 | 200 | wheat 1 |
|  | 92 | 201 | wheat 2 |
| FUE_52 | 93 | 202 | maize |
| FUE_53 | 94 | 203 | maize |
|  | 95 | 204 | sorghum |
|  | 96 | 205 | rice |
|  | 97 | 206 | wheat |
| FUE_54 | 98 | 207 | maize |
|  | 99 | 208 | sorghum |
|  | 100 | 209 | rice |
| FUE_55 | 739 | 1288 | maize |
| FUE_100 | 102 | 211 | maize |
| FUE_101 | 103 | 212 | maize |
| FUE_102 | 104 | 213 | maize |
| FUE_501 | 105 | 214 | *Arabidopsis thaliana* |
| FUE_502 | 106 | 215 | *Arabidopsis thaliana* |
| FUE_503 | 107 | 216 | *Arabidopsis thaliana* |
| FUE_504 | 108 | 217 | *Arabidopsis thaliana* |
| FUE_505 | 109 | 218 | *Arabidopsis thaliana* |

Of note, overexpression Fold ("Fold") is calculated as the ratio between the number of ESTs found in a gene or an orthologue group for a certain category ("Keyword") and the number of expected ESTs according to a normal distribution. A probabilistic value (P-value) was estimated for the calculated overexpression folds. Genes were selected based on the results presented here and other computational filtering combined with manual curation as detailed above.

Figure 2B:
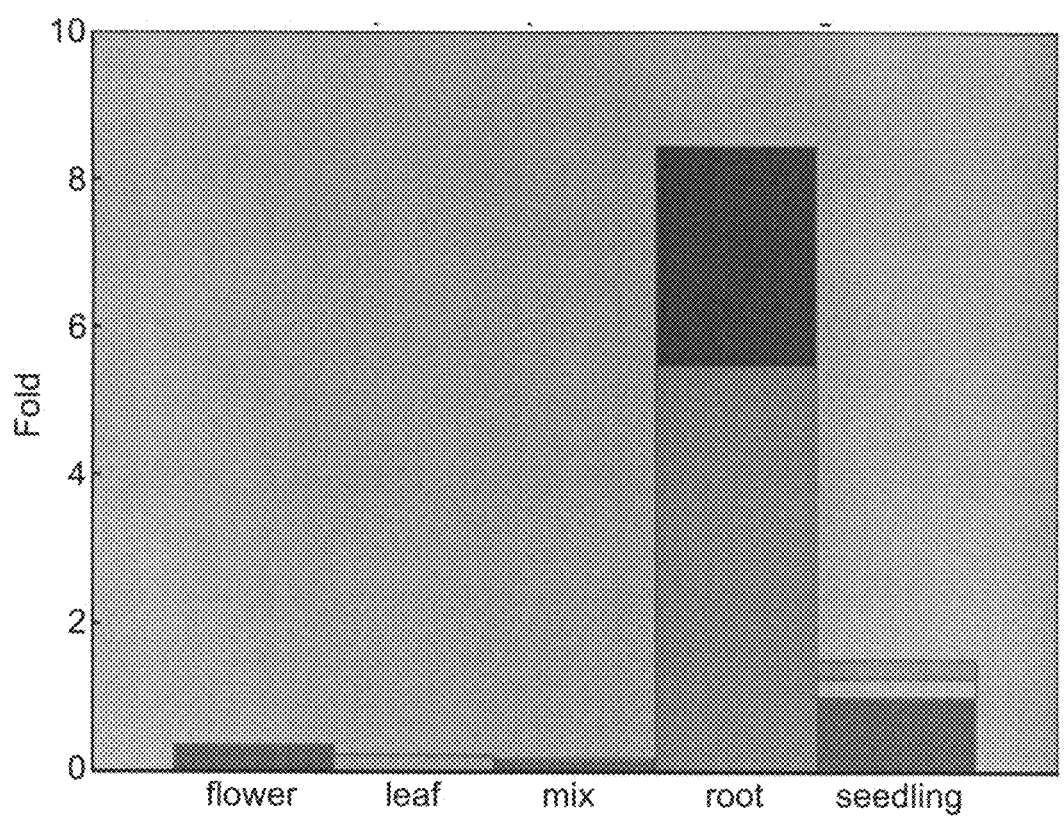
Figure 2D:
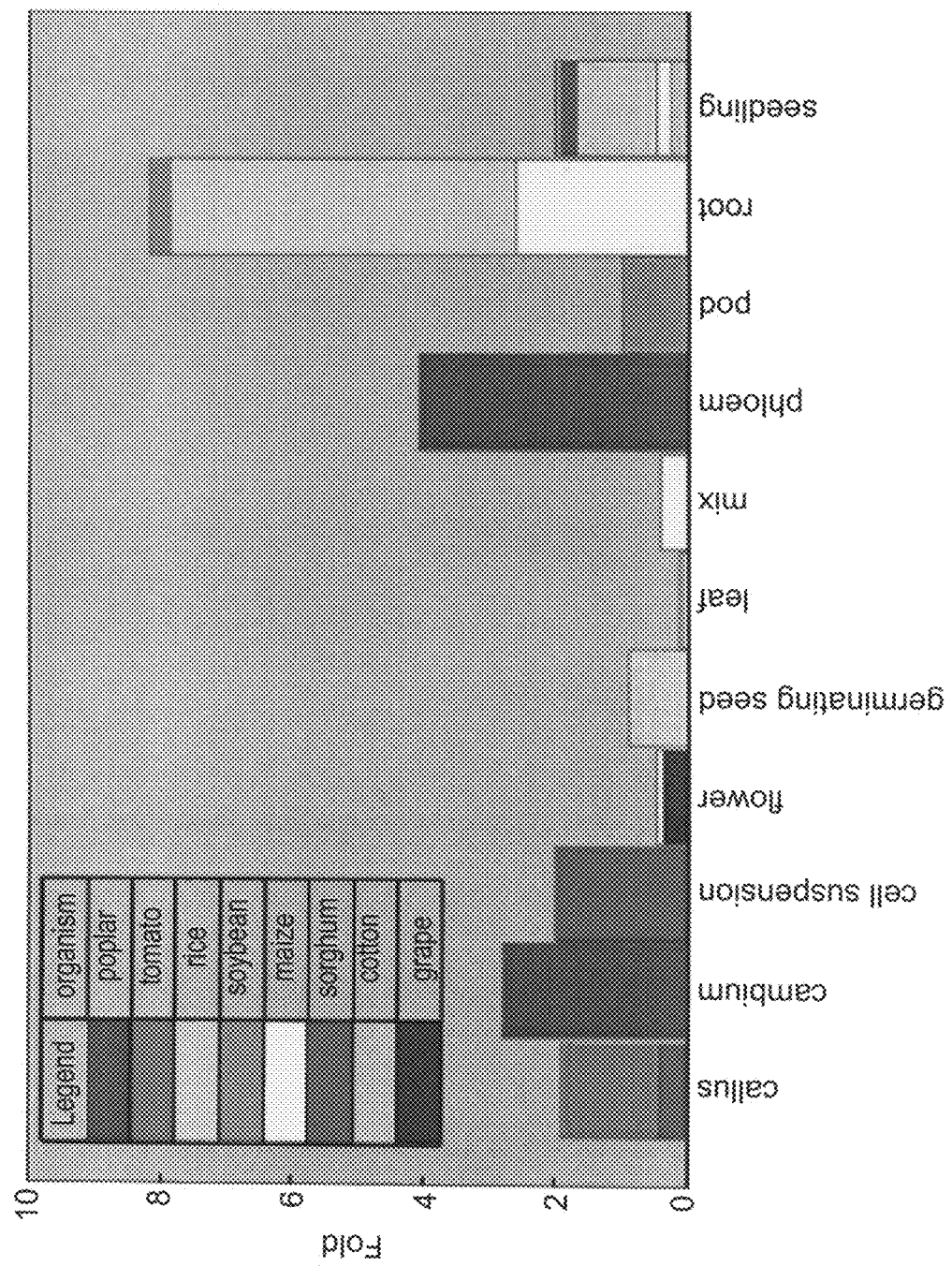

FUE_1 was selected for its strong root expression in maize (as shown in Table 2 and FIG. 2A and 2B), as well as the expression pattern of its orthologues such as in soybean and rice (as shown in Table 3 and FIG. 2C and 2D). In addition, FUE_1 displays some homology to RCc3 protein (GENEBANK Accession NO. L27208) a known root specific protein putatively associated with lipid transport.

TABLE 2

Digital expression of FUE_1 in maize: Anatomy

| Primary Keyword | Secondary Keyword | ESTs in Gene | ESTs in Production | Expected ESTs | Fold | p-value |
|---|---|---|---|---|---|---|
| flower |  | 4 | 89278 | 10.8145 | 0.369873 | 0.997498 |
|  | seedling + female flower | 4 | 9012 | 1.09165 | 3.66417 | 0.0234977 |
| leaf |  | 1 | 35689 | 4.32312 | 0.231314 | 0.989277 |
|  | ear leaf | 1 | 7960 | 1 | 1 | 0.622546 |
| mix |  | 2 | 90046 | 10.9076 | 0.183359 | 0.999938 |
| root |  | 37 | 36059 | 4.36794 | 8.47082 | 1.78E−15 |
|  | primary root system | 24 | 33886 | 4.10472 | 5.84693 | 7.82E−14 |
|  | root tip | 13 | 2173 | 1 | 13 | 2.22E−15 |
| seedling |  | 6 | 32466 | 3.93271 | 1.52567 | 0.19702 |
|  | seedling + female flower | 4 | 9012 | 1.09165 | 3.66417 | 0.0234977 |
|  | shoot | 1 | 16152 | 1.95654 | 0.511106 | 0.864469 |

TABLE 3

Digital expression of FUE_1 ortholog group: Anatomy

| | callus | cambium | cell suspension | flower | germinating seed | leaf | mix | phloem | pod | root | seedling |
|---|---|---|---|---|---|---|---|---|---|---|---|
| cotton | | | | | | | | | | | 0.26 |
| grape | | | | 0.39 | | | | | | | |
| maize | | | | 0.07 | | 0.06 | 0.4 | | | 2.61 | 0.2 |
| poplar | | 2.8 | | | | | | 4.1 | | | |
| rice | | | | | 0.9 | 0.08 | | | | 5.25 | 1.24 |
| *sorghum* | 0.46 | | 2 | | | | | | | | 0.21 |
| soybean | | | | | | | | | 1 | 0.31 | 0.11 |
| tomato | 1.46 | | | | | | | | | | |
| TOTAL | 1.92 | 2.8 | 2 | 0.47 | 0.9 | 0.14 | 0.4 | 4.1 | 1 | 8.17 | 2.02 |

FUE_2 is a protein of unknown function displaying a digital expression linking it to roots and particularly to roots under drought stress.

FUE_3 is a putative non-specific lipid transfer protein expressed particularly in roots in maize (Table 4 and Table 5), but also in barley and rice. Its expression in roots under drought is conserved throughout evolution in sorghum, maize, rice and barley (as shown in Table 6 and 7). There are indications that the gene is expressed also under salinity stress in barley and rice and under nitrogen deficiency in barley.

TABLE 4

Digital expression of FUE_3 in maize: Anatomy

| Keyword | Secondary Keyword | ESTs in Gene | ESTs in Production | Expected ESTs | Fold | p-value |
|---|---|---|---|---|---|---|
| flower | | 1 | 89278 | 7.82327 | 0.127824 | 0.999862 |
| | seedling + female flower | 1 | 9012 | 1 | 1 | 0.550246 |
| mix | | 2 | 90046 | 7.89057 | 0.253467 | 0.998578 |
| root | | 30 | 36059 | 3.15978 | 9.49432 | 2.66E−15 |
| | primary root system | 30 | 33886 | 2.96937 | 10.1032 | 0 |
| seedling | | 2 | 32466 | 2.84494 | 0.703003 | 0.789648 |
| | seedling + female flower | 1 | 9012 | 1 | 1 | 0.550246 |
| | shoot | 1 | 16152 | 1.41537 | 0.706529 | 0.764428 |

TABLE 5

Digital expression of FUE_3 in maize: Treatment

| Keyword | Secondary Keyword | ESTs in Gene | ESTs in Production | Expected ESTs | Fold | p-value |
|---|---|---|---|---|---|---|
| drought | | 30 | 21216 | 1.85912 | 16.1367 | 3.44E−15 |
| | water stress 48 h | 17 | 6113 | 1 | 17 | 0 |
| | water stress 5 h | 6 | 6417 | 1 | 6 | 1.84E−05 |
| | water stress 5 h and 48 h, Subtracted library | 7 | 2720 | 1 | 7 | 3.76E−09 |
| mix | | 2 | 36475 | 3.19624 | 0.625736 | 0.8422 |

TABLE 6

Digital expression of FUE_3 ortholog group: Anatomy

| | culm | flower | germinating seed | grain | leaf | mix | rachis | root | seedling | shoot |
|---|---|---|---|---|---|---|---|---|---|---|
| barley | 1 | | 0.39 | 0.19 | 0.03 | | 2.24 | 1.4 | 0.18 | |
| maize | | 0.07 | | | | 0.34 | | 2.66 | 0.08 | |
| rice | | | | | 0.24 | | | 0.9 | 0.31 | 0.2 |
| *sorghum* | | | | | 0.67 | | | | | |
| TOTAL | 1 | 0.07 | 0.39 | 0.19 | 0.95 | 0.34 | 2.24 | 4.95 | 0.58 | 0.2 |

TABLE 7

Digital expression of FUE_3 ortholog group: Treatment

| | drought | light response | mix | nutrient deficiencies | pathogen | photoperiod response | salinity | waterlogged |
|---|---|---|---|---|---|---|---|---|
| barley | 0.81 | 0.92 | | 0.53 | 0.07 | | | 1 |
| maize | 6.51 | | 0.83 | | | | | |
| rice | 2.29 | | | | | 8 | 3.48 | |
| *sorghum* | 1.61 | | | | 0.34 | | | |
| TOTAL | 11.22 | 0.92 | 0.83 | 0.53 | 0.42 | 8 | 3.48 | 1 |

FUE_4 is also a protein of unknown function displaying specific digital expression under drought stress (as shown in Table 8 and 9).

TABLE 8

Digital expression of FUE_4 in maize: Anatomy

| Keyword | Secondary Keyword | ESTs in Gene | ESTs in Production | Expected ESTs | Fold | p-value |
|---|---|---|---|---|---|---|
| root | | 6 | 36059 | 1 | 6 | 6.44E−07 |
| | primary root system | 6 | 33886 | 1 | 6 | 4.44E−07 |

TABLE 9

Digital expression of FUE_4 in maize: Treatment

| Keyword | | ESTs in Gene | ESTs in Production | Expected ESTs | Fold | p-value |
|---|---|---|---|---|---|---|
| drought | | 6 | 21216 | 1 | 6 | 2.67E−08 |
| | water stress 48 h | 3 | 6113 | 1 | 3 | 7.54E−05 |
| | water stress 5 h | 3 | 6417 | 1 | 3 | 8.71E−05 |

FUE_5 is a Ubiquinol-cytochrome C reductase complex like protein expressed under several stresses and particularly under drought and salinity in maize (as shown in Table 10) and rice roots.

TABLE 10

Digital expression of FUE_5 in maize: Treatment

| Keyword | Secondary Keyword | ESTs in Gene | ESTs in Production | Expected ESTs | Fold | p-value |
|---|---|---|---|---|---|---|
| drought | | 16 | 21216 | 2.67932 | 5.97167 | 3.75E−09 |
| | CONTROL well watered 0 h | 1 | 5966 | 1 | 1 | 0.532021 |
| | water stress 48 h | 9 | 6113 | 1 | 9 | 6.92E−08 |
| | water stress 5 h | 4 | 6417 | 1 | 4 | 0.00876739 |
| | water stress 5 h and 48 h, Subtracted library | 2 | 2720 | 1 | 2 | 0.0465022 |
| mix | | 3 | 36475 | 4.60634 | 0.651276 | 0.851418 |

TABLE 10-continued

Digital expression of FUE_5 in maize: Treatment

| Keyword | Secondary Keyword | ESTs in Gene | ESTs in Production | Expected ESTs | Fold | p-value |
|---|---|---|---|---|---|---|
| pathogen | | 1 | 2260 | 1 | 1 | 0.248934 |
| | *Fusarium*, 6 h post infection | 1 | 667 | 1 | 1 | 0.0808552 |
| salinity | | 3 | 3579 | 1 | 3 | 0.0105368 |
| | 150 mM NaCl 24 h | 3 | 3579 | 1 | 3 | 0.0105368 |

FUE_6 displays homology to a multiple stress-associated zinc-finger protein, expressed in maize during grain development and in roots, particularly under drought stress (as shown in Tables 11 and 12 respectively). The present inventors uncovered that FUE_6 and FUE_40 are part of the same transcript. FUE_6 represents the 5' region of the transcript, while FUE_40 the 3' region. For convenience, this transcript is presented in this herein under the name FUE_40.

TABLE 11

Digital expression of FUE_6 in maize: Anatomy

| Keyword | Secondary Keyword | ESTs in Gene | ESTs in Production | Expected ESTs | Fold | p-value |
|---|---|---|---|---|---|---|
| grain | | 1 | 73038 | 2.07065 | 0.48294 | 0.899148 |
| | glume | 1 | 2043 | 1 | 1 | 0.0564193 |
| root | | 10 | 36059 | 1.02228 | 9.78202 | 4.83E-10 |
| | primary root system | 10 | 33886 | 1 | 10 | 2.61E-10 |

TABLE 12

Digital expression of FUE_6 in maize: Treatment

| Keyword | Secondary Keyword | ESTs in Gene | ESTs in Production | Expected ESTs | Fold | p-value |
|---|---|---|---|---|---|---|
| drought | | 10 | 21216 | 1 | 10 | 2.50E-12 |
| | CONTROL well watered 0 h | 2 | 5966 | 1 | 2 | 0.011856 |
| | water stress 48 h | 1 | 6113 | 1 | 1 | 0.16028 |
| | water stress 5 h | 4 | 6417 | 1 | 4 | 2.25E-05 |
| | water stress 5 h and 48 h, Subtracted library | 3 | 2720 | 1 | 3 | 5.44E-05 |

FUE_7 is a hypothetical protein displaying similarity to antifreeze protein expressed predominantly in barley and maize in roots and with a more evident expression during drought stress (as shown in Table 13 and 14).

TABLE 13

Digital expression of FUE_7 ortholog group: Anatomy

| | flower | grain | leaf | mix | root | seedling |
|---|---|---|---|---|---|---|
| barley | | 0.96 | 0.33 | | 1.86 | 0.21 |
| maize | 0.15 | 0.83 | | 0.39 | 4.28 | 0.34 |
| *sorghum* | | | 1.13 | | | |
| TOTAL | 0.15 | 1.79 | 1.46 | 0.39 | 6.14 | 0.55 |

TABLE 14

Digital expression of FUE_7 ortholog group: Treatment

| | drought | pathogen | salinity | waterlogged |
|---|---|---|---|---|
| barley | 3.47 | 0.38 | | 1 |
| maize | 9.64 | | 1 | |
| sorghum | 7.75 | | | |
| TOTAL | 20.87 | 0.38 | 1 | 1 |

FUE$_{13}$ 8 displays homology to Acyl-ACP thioesterase and expressed in maize roots under drought stress (as shown in Table 15). The sorghum and rice orthologues show also a clear association to drought as revealed by the source of the sequences composing the genes.

TABLE 15

Digital expression of FUE_8 in maize: Anatomy

| Keyword | Secondary Keyword | ESTs in Gene | ESTs in Production | Expected ESTs | Fold | p-value |
|---|---|---|---|---|---|---|
| root | | 6 | 36059 | 1 | 6 | 6.44E-07 |
| | primary root system | 6 | 33886 | 1 | 6 | 4.44E-07 |

FUE_9 is a hypothetical protein expressed in maize roots under drought stress.

FUE_10 displays homology to electron transport-associated proteins. displaying a strong root expression solely associated to drought in maize (as shown in Table 16 and 17) and to other abiotic stresses as found for its orthologue expression in soybean.

TABLE 16

Digital expression of FUE_10 in maize: Anatomy

| Keyword | Secondary Keyword | ESTs in Gene | ESTs in Production | Expected ESTs | Fold | p-value |
|---|---|---|---|---|---|---|
| flower | | 1 | 89278 | 3.22135 | 0.310429 | 0.974291 |
| | seedling + female flower | 1 | 9012 | 1 | 1 | 0.280367 |
| grain | | 1 | 73038 | 2.63537 | 0.379453 | 0.946054 |
| | pericarp | 1 | 9389 | 1 | 1 | 0.290325 |
| mix | | 2 | 90046 | 3.24906 | 0.615563 | 0.870275 |
| root | | 8 | 36059 | 1.30109 | 6.1487 | 9.97E−06 |
| | primary root system | 8 | 33886 | 1.22268 | 6.543 | 6.26E−06 |
| seedling | | 2 | 32466 | 1.17145 | 1.70729 | 0.329608 |
| | seedling + female flower | 1 | 9012 | 1 | 1 | 0.280367 |
| | shoot | 1 | 16152 | 1 | 1 | 0.448596 |

TABLE 17

Digital expression of FUE_10 in maize: Treatment

| Keyword | Secondary Keyword | ESTs in Gene | ESTs in Production | Expected ESTs | Fold | p-value |
|---|---|---|---|---|---|---|
| drought | | 8 | 21216 | 1 | 8 | 1.78E−07 |
| | water stress 48 h | 5 | 6113 | 1 | 5 | 1.72E−06 |
| | water stress 5 h | 2 | 6417 | 1 | 2 | 0.0218099 |
| | water stress 5 h and 48 h, Subtracted library | 1 | 2720 | 1 | 1 | 0.093796 |
| mix | | 2 | 36475 | 1.3161 | 1.51964 | 0.384279 |

FUE_11 displays homology to the physical impedance induced protein and is expressed in maize in roots also during drought stress.

FUE_12 is an unknown protein expressed in maize roots under water stress (drought) and in other abiotic stresses such as drought in barley and under nitrogen deficiency and heat stress in sorghum.

FUE_13 displays homology to Pathogenesis-related protein 10, and is expressed in different stresses in maize (drought, pathogens as *Fusarium*). The barley and rice orthologues are strongly expressed particularly under abiotic and biotic stresses linking this protein to the ubiquitous plant response to stress.

FUE_14 is a maize protein displaying homology to Germin-like protein 6. The digital expression of its barley orthologue links this protein to pathogen response, as well as drought and nitrogen deficiency response.

FUE_15 is a putative auxin-regulated protein also expressed in maize roots. Its orthologues from barley, rice and are related to drought as well as other biotic and abiotic stresses such as pathogen response. In tomato and soybean, the protein is linked to the response to pathogens and nutrient deficiencies.

FUE_16 is an Uclacyanin 3-like protein, expressed strongly in maize roots under water stress (as shown in Table 18 and 19). Its orthologues from barley, rice, soybean and tomato are also expressed in roots but involved in the response to other several biotic and abiotic stresses particularly to light response (as shown in Table 20 and 21).

TABLE 18

Digital expression of FUE_16 in maize: Anatomy

| Keyword | Secondary Keyword | ESTs in Gene | ESTs in Production | Expected ESTs | Fold | p-value |
|---|---|---|---|---|---|---|
| flower | | 3 | 89278 | 3.91163 | 0.766943 | 0.78613 |
| | seedling + female flower | 3 | 9012 | 1 | 3 | 0.00667346 |
| root | | 14 | 36059 | 1.57989 | 8.86136 | 1.86E−12 |
| | primary root system | 14 | 33886 | 1.48468 | 9.42961 | 7.90E−13 |
| seedling | | 3 | 32466 | 1.42247 | 2.10901 | 0.165456 |
| | seedling + female flower | 3 | 9012 | 1 | 3 | 0.00667346 |

TABLE 19

Digital expression of FUE_16 in maize: Treatment

| Keyword | Secondary Keyword | ESTs in Gene | ESTs in Production | Expected ESTs | Fold | p-value |
|---|---|---|---|---|---|---|
| drought | | 14 | 21216 | 1 | 14 | 3.77E−15 |
| | CONTROL well watered 0 h | 2 | 5966 | 1 | 2 | 0.0275854 |
| | water stress 48 h | 4 | 6113 | 1 | 4 | 0.000124308 |
| | water stress 5 h | 6 | 6417 | 1 | 6 | 2.16E−07 |
| | water stress 5 h and 48 h, Subtracted library | 2 | 2720 | 1 | 2 | 0.00622988 |

TABLE 20

Digital expression of FUE_16 ortholog group: Anatomy

| | culm | flower | leaf | mix | root | seed | seedling | shoot | xylem |
|---|---|---|---|---|---|---|---|---|---|
| barley | 1 | 0.45 | 0.1 | | 0.48 | | | | |
| maize | | 0.17 | | | 2.14 | | 0.48 | | |
| poplar | | | | | 0.24 | | | | 1.57 |
| rice | | | | 0.33 | 3.62 | | 0.51 | | |
| *sorghum* | | | | | | | 0.4 | | |
| soybean | | 0.49 | 0.04 | 0.07 | 0.43 | 3 | 0.71 | 0.46 | |
| tomato | | | | | 0.48 | | | | |
| TOTAL | 1 | 1.11 | 0.14 | 0.41 | 7.41 | 3 | 2.11 | 0.46 | 1.57 |

TABLE 21

Digital expression of FUE_16 ortholog group: Treatment

| | chemical treatment | cold stress | drought | heat stress | light response | nodulation | nutrient deficiencies | pathogen | salinity |
|---|---|---|---|---|---|---|---|---|---|
| barley | | | | | | | | | |
| maize | | | 3.98 | | 0.63 | | | | |
| poplar | | | | | | | 1.12 | | |
| rice | 1 | | | | 0.63 | | | | 2 |
| *sorghum* | | | | | 1.9 | | | | |
| soybean | 1 | 1 | | 1 | 1.56 | 5 | 2.85 | 1.09 | |
| tomato | | | | | | | 1.12 | | |
| TOTAL | 2 | 1 | 3.98 | 1 | 4.73 | 5 | 5.09 | 1.09 | 2 |

FUE_17 is a hypothetical protein displaying a digital expression in maize and other plant species linking it to a response to drought (maize, barley and sorghum), to pathogens (rice, soybean and tomato) and to nitrogen deficiency and water-logging in barley.

FUE_30 and FUE_31 were selected because of their annotation and the significant EST content derived from root particularly in the case of FUE_30. FUE_30 and FUE_31 have a predicted invertase activity, an enzyme which is known to delay senescence when expressed under a senescence-activated promoter (Balibrea Lara, et al. Plant Cell 16: 1276-1287, 2004). FUE_30 can extend the stay-green characteristics of the plant and therefore increase the overall capacity to store nitrogen in plants for redistribution during grain filling.

FUE_32 is annotated as major intrinsic like protein and its wheat orthologue contains several sequences isolated from root. In addition, the maize gene selected shows homology to Brevis Radix. Brevis Radix is a novel regulator of cell proliferation and elongation that when inactive it creates plants with shorter roots (Mouchel at al., Genes and Development Vol. 18:700-714, 2004).

FUE_54 displays homology to an Auxin responsive protein. The genes contain a significant EST annotation from roots and stressed tissues, as well as its best orthologue from sorghum and rice that are specially expressed under stress conditions and probably enriched in the root.

FUE_33 and FUE_100 encode for nitrilases. Nitrilase is an important enzyme in the auxin biosynthetic pathway that converts 3-indoleacetonitrile to 3-indole-acetic acid (auxin). Increased expression of Nitrilases in the root will enlarge the overall auxin levels and induce root elongation, secondary root formation, enhanced gravitropic response, etc.

FUE_34 and FUE_35 as well as FUE_46 and FUE_47 are probable transcription factors both expressed particularly in stressed roots as judged by the EST libraries providing the sequences of the genes. As these transcription factors are highly associated with water stressed libraries it may occur that modifying the expression of these genes will activate the genes that induce the structural and metabolic changes associated with stresses.

FUE_36, FUE_37 and FUE_38 show some degree of similarity to ABA-responsive genes and/or stress annotated genes, and have a significant content of sequences derived from root libraries. FUE_36 has probably protein kinase activity with a striking similarity to a SAPK8, a protein that its expression levels are increased during ABA treatment or under salinity conditions, demonstrating a role in the stress response. FUE_37 has almost all the sequences derived from root and particularly root under water stress (as shown in Tables 22 and 23). The orthologues from barley, wheat and sugar cane also support the contention that the gene is mainly expressed in roots. There are indications that this gene is implicated in the response to water stress deprivation, hyper-osmotic salinity response, cold and other stresses.

TABLE 22

Digital expression of FUE_37 ortholog group: Anatomy

| | callus | fruit | leaf | mix | root | seedling | stem | xylem |
|---|---|---|---|---|---|---|---|---|
| barley | | | 0.35 | | 0.84 | 0.24 | | |
| grape | | 2.37 | | | | | | |
| maize | | | | 0.26 | 0.84 | | | |
| poplar | | | 0.09 | | | | | 7 |
| rice | 0.26 | | 0.34 | | | | | |
| soybean | 0.29 | | 0.2 | 0.31 | 0.21 | | 1 | |
| TOTAL | 0.55 | 2.37 | 0.99 | 0.57 | 1.9 | 0.24 | 1 | 7 |

TABLE 23

Digital expression of FUE_37 ortholog group: Treatment

| | drought | hormone treatment | mix | nodulation | pathogen | salinity |
|---|---|---|---|---|---|---|
| barley | 1.19 | | | | 0.14 | |
| maize | 0.4 | | | | | 1 |
| rice | 2.38 | 0.36 | | | | |
| soybean | 0.4 | | 0.69 | 1 | | |
| TOTAL | 4.37 | 0.36 | 0.69 | 1 | 0.14 | 1 |

FUE_38 is derived from various stressed root libraries (as shown in Tables 24 and 25) and displays a notorious similarity to PKABA1. PKABA1 transcript levels are barely detectable in growing seedlings but are induced dramatically when plants are subjected to dehydration, cold and osmotic stress (Holappa L D and Walker-Simmons M K Plant Physiol. Vol. 108:1203-1210, 1995). A modified expression pattern for this gene can provide increased abiotic stress tolerance, increased vigor, increased yield and better use efficiency of fertilizers.

TABLE 24

Digital expression of FUE_38 ortholog group: Anatomy

| Keyword | Secondary Keyword | ESTs in Gene | ESTs in Production | Expected ESTs | Fold | p-value |
|---|---|---|---|---|---|---|
| cell culture | | 3 | 16132 | 1 | 3 | 0.0367348 |
| flower | | 1 | 89278 | 4.14173 | 0.241445 | 0.990968 |
| | seedling + female flower | 1 | 9012 | 1 | 1 | 0.344935 |
| grain | | 1 | 73038 | 3.38834 | 0.29513 | 0.976577 |
| | endosperm | 1 | 25774 | 1.19569 | 0.836336 | 0.709829 |
| mix | | 2 | 90046 | 4.17736 | 0.478771 | 0.944464 |
| root | | 10 | 36059 | 1.67283 | 5.9779 | 1.04E−06 |
| | primary root system | 10 | 33886 | 1.57202 | 6.36125 | 5.83E−07 |
| seedling | | 1 | 32466 | 1.50614 | 0.663948 | 0.792566 |
| | seedling + female flower | 1 | 9012 | 1 | 1 | 0.344935 |

TABLE 25

Digital expression of FUE_38 ortholog group: Treatment

| | drought | hormone treatment | light response | mechanical treatment | mix | nodulation | pathogen | salinity |
|---|---|---|---|---|---|---|---|---|
| barley | 0.26 | | | | | | | 0.93 |
| maize | 2.3 | | | | 0.45 | | | 0.93 |
| rice | | | 0.65 | | | | 0.13 | |

TABLE 25-continued

Digital expression of FUE_38 ortholog group: Treatment

|  | drought | hormone treatment | light response | mechanical treatment | mix | nodulation | pathogen | salinity |
|---|---|---|---|---|---|---|---|---|
| *sorghum* | 0.26 | 0.46 | | 2 | | | | 0.93 |
| soybean | 0.26 | | | | | 2.75 | 0.14 | |
| TOTAL | 3.07 | 0.46 | 0.65 | 2 | 0.45 | 2.75 | 0.27 | 2.8 |

FUE_48 was selected using microarray *Arabidopsis* expression data available at (Hypertext Transfer Protocol:// affymetrix (dot) arabidopsis (dot) info/inarrays/supersearch (dot) pl?searchterms=afgn). Genes with enriched expression in roots and highly responsive to ABA and abiotic stresses (salinity, osmoticum and cold) were identified. One of the genes had an orthologue in maize (FUE_48) that showed enhanced content of root-derived sequences. The probable sorghum orthologue is a gene mainly composed by stress-derived sequences, particularly from water stress and drought conditions (as shown in Table 26). FUE_48 shows similarity to SIP (Seed Imbibition Protein).

provide advantageous properties or desired traits compared to a reference plant, including improved abiotic stress tolerance, increased vigor and yield, improved use of fertilizer, etc.

FUE_40 and FUE_41 are genes expressed in roots particularly at stress conditions. The sorghum orthologue of FUE_40 has several sequences derived from stressed tissues including roots. FUE_41 and FUE_40 show similarity to stress-responsive proteins.

FUE_43, FUE_44 and FUE_45 have a distant similarity to an *E. coli* universal stress protein and their composing sequences contain a significant fraction of root stressed tissues (as shown in Table 27 for FUE_43 and in Table 28 for

TABLE 26

Digital expression of FUE_48 ortholog group: Treatment

|  | drought | heat stress | hormone treatment | light response | nematode | nutrient deficiencies | pathogen | salinity |
|---|---|---|---|---|---|---|---|---|
| barley | 0.98 | | | | | | | |
| cotton | | | | | | | 0.09 | |
| maize | 0.73 | | | | | | | 0.18 |
| poplar | | | 0.11 | | | 0.23 | 0.25 | |
| rice | 0.51 | | | 0.19 | | | 0.27 | 0.53 |
| *sorghum* | 3.20 | 0.71 | 0.04 | 0.15 | | | | |
| soybean | | | | 0.41 | 1.78 | 0.40 | 0.16 | 0.18 |
| tomato | | | 0.12 | | | 0.13 | | |
| TOTAL | 5.42 | 0.71 | 0.27 | 0.75 | 1.78 | 0.76 | 0.77 | 0.89 |

FUE_39 is a root-expressed calcineurin B-like $Ca^{++}$ binding protein. Calcineurins are $Ca^{++}$ sensing protein kinases differentially regulated by stress conditions such as salt, drought, cold, and wounding stress. Calcium is involved in several root important behaviors such as gravitropism, hydrotropism, etc and is an important second messenger for various signal transduction pathways. Continuous activation of the protein cascade in which FUE_39 is involved can FUE_44). FUE_43 shows similarity to an ethylene-responsive protein. FUE_44 and FUE_45 show a weak similarity to an early nodulin-like protein. Those proteins expressed ectopically under a different promoter are likely to produce favorable effects in the transgenic plants such as enhanced stress tolerance, improved growth at optimal and adverse conditions mainly due to probable modifications in the root architecture.

TABLE 27

Digital expression of FUE_43 ortholog group: Treatment

|  | Control Library | drought | hormone treatment | light response | mix | nodulation | nutrient deficiencies | pathogen | salinity |
|---|---|---|---|---|---|---|---|---|---|
| barley | 1.00 | | | 0.33 | | | | 0.09 | |
| maize | | 1.42 | | | 1.55 | | | | 0.83 |
| rice | | 0.83 | | 1.64 | | | | | |

TABLE 27-continued

Digital expression of FUE_43 ortholog group: Treatment

| | Control Library | drought | hormone treatment | light response | mix | nodulation | nutrient deficiencies | pathogen | salinity |
|---|---|---|---|---|---|---|---|---|---|
| sorghum | | 1.60 | | 0.91 | | | 0.63 | | |
| soybean | | | 0.43 | | | 0.81 | | 0.22 | |
| tomato | | | | | | | | 0.10 | |
| TOTAL | 1.00 | 3.86 | 0.43 | 2.88 | 1.55 | 0.81 | 0.63 | 0.41 | 0.83 |

TABLE 28

Digital expression of FUE_44 ortholog group: Treatment

| | chemical treatment | drought | light response | nematode | nutrient deficiencies | pathogen | salinity | waterlogged |
|---|---|---|---|---|---|---|---|---|
| barley | | 0.66 | | | | 0.28 | | |
| grape | | | | | | 0.07 | | |
| maize | | 0.92 | | | | | 1.69 | |
| poplar | | | | | 0.52 | 0.20 | | |
| rice | | | 0.50 | | | 0.07 | | |
| sorghum | | 0.66 | 0.50 | | | | | |
| soybean | 3.00 | 0.44 | 0.33 | 2.00 | 1.30 | 0.08 | 0.85 | 5.00 |
| tomato | | | | | | | | |
| TOTAL | 3.00 | 2.67 | 1.34 | 2.00 | 1.82 | 0.69 | 2.54 | 5.00 |

FUE_50 was selected using microarray *Arabidopsis* expression data in which root specific genes were selected if they were also auxin and ethylene responsive. According to the calculated digital expression, the maize orthologue presented in this invention is expressed in roots under water stress conditions and in pathogenesis related tissues. The maize gene shows similarity to nodulin, a protein known to be involved during nodule and lateral root development (Papadopoulou et al. Plant Mol. Biol. 1996; 30:403-17).

FUE_501 is a putative *Arabidopsis thaliana* amino acid transporter that shows increased expression under salinity, osmoticum and is also Abscisic acid responsive (ABA—abiotic stress response hormone). FUE_51, a maize homologue of FUE_501 is composed mainly by sequences derived from stressed root sequences and has a tentative annotation as an amino acid transporter. The sorghum orthologue of FUE_51 is involved in stress responses according to the digital expression. Its barley orthologue has sequences derived from roots and stressed roots. Also the wheat orthologue shows several sequences derived from root.

FUE_502 is a putative amino acid transporter which shows increased expression during salinity stress and osmoticum both in roots and shoots. FUE_52, its closest maize orthologue, has also similarity to amino acid transport proteins and has a significant representation of root and stressed root derived sequences.

FUE_503 has an impressive expression in seeds suggesting a strong role in uptake of amino acids into the developing seeds. In addition the gene is strongly upregulated under salinity and in response to methyl jasmonate. FUE_504 was chosen because of its strong response to ABA, to salinity (specially of the shoot), to osmoticum, and cold. FUE_49 shows a strong similarity at the level of translated amino acids to FUE_504 but low at the level of coding nucleotides. Its sorghum orthologue has sequences significantly derived from water stress/drought libraries.

FUE_53 is a putative amino acid transporter with almost of all the sequences composing the genes derived from root and particularly stressed roots. The sorghum, rice and wheat orthologues contain several sequences derived from root and root under stress libraries.

FUE_101 and FUE_102 show similarity to amino acid transporters. FUE_102 is specifically composed from sequences derived from cold treated seedlings and pathogen infected corn ear tip.

FUE_55 is a gene with a striking similarity to tRNA isopentenyltransferase, an important enzyme in the cytokinin metabolic pathway. Increased expression of FUE_55 in the roots or shoots will increase the levels of cytokinin leading to enhanced leaf expansion and cell duplication, delayed senescence, increased sink strength of the tissues, enhanced nitrogen utilization, etc. FUE_55 is particularly expressed in the endosperm, a tissue that is probably the strongest sink in the plant.

FUE_505 is a putative AP2 domain-containing transcription factor present in two important list of genes. One list contains the genes that are Zeatin responsive (Zeatin is a naturally occurring cytokinin) while the second list of genes contains nitrogen induced genes after nitrogen addition to nitrogen starved plants (Wang et al., Plant Physiology, June 2003, Vol. 132, pp. 556-567). FUE_505 was found in the cluster of the ARR (Arabidopsis response regulators) which mediate the response of the shoot to cytokinin. Root cytokinin production increase upon nitrogen availability (Yamada et al. FEBS Lett. Vol. 436, pp:76-80, 1998). Its co-regulation together with ARRs indicates a possible role in the cytokinin response. It is highly likely that constitutive expression of FUE_505 will improve nitrogen utilization and plant growth due to continuous activation of the cytokinin response of the shoot.

Example 2 mRNA Expression of in-silico Expressed Polynucleotides mRNA levels are determined using reverse transcription assay followed by quantitative Real-Time PCR (qRT-PCR) analysis. RNA levels are compared between different tissues, developmental stages, growing conditions and/or different genetic backgrounds. A correlation analysis between mRNA levels in different experimental conditions/genetic backgrounds as evidence for the role of the gene in the plant.

Methods

RT-PCR analysis—Root and leaves were excised fresh from maize plants grown on 10 liter white buckets filled with Vermiculite Size 3. Buckets were watered with tap water until seeds from a commercial hybrid germinated. During the entire growth period (5 weeks), the plants were irrigated with 2 liter/bucket/day with a solution pH 5.7-5.8 containing 2 mM $CaCl_2$, 1 mM $MgSO_4$, 1 mM $KH_2PO_4$, 7 mM KCl and microelements cocktail. Ammonium nitrate was added at the following concentrations: 5 mM, 0.5 mM, 0.05 mM, 0.005 mM or not at all. For experiments with Potassium nitrate instead of ammonium nitrate, the concentrations were as follow 2 mM $CaCl_2$, 2 mM $MgSO_4$, 1 mM $KH_2PO_4$, 5 mM KCl, and either one of the following concentrations of $KNO_3$: 5 mM, 1 mM, 0.1 mM, 0.01 mM, maintained to a final concentration of potassium of 10 mM with supplemental concentrations of KCl.

Quantitative Real Time RT-PCR (qRT-PCR)—To verify the levels of expression, specificity and trait-association, Reverse Transcription followed by quantitative Real-Time PCR (qRTPCR) was effected on total RNA extracted from several parts of the plant including for example mature and juvenile leaves, roots and root meristems, husks, tassels, silks, etc. from plants grown on soil or pots under optimal or nutrient deficient conditions as described above. Messenger RNA (mRNA) levels are measured for all the genes, previously predicted bioinformatically to be associated with Fertilizer Use Efficiency and correlation between expression levels and the plant nutrient status was analysed. Total RNA was extracted from leaves or roots of maize, using RNeasy plant mini kit (Qiagen, Germany) using the protocol provided by the manufacturer. Reverse transcription was performed using 1.5 μg total RNA, using 300 U Super Script II Reverse Transcriptase enzyme (Invitrogen), 225 ng random deoxynucleotide hexamers (Invitrogen), 500 μM dNTPs mix (Takara, Japan), 0.2 volume of ×5 RT buffer (Invitrogen), 0.01M DTT, 60 U RNAsin (Promega), DEPC treated DDW was added up to 37.5 μl. RT reactions were incubated for 50 min at 42° C., followed by 70° C. for 15 min. cDNA was diluted 1:20 in Tris EDTA, pH=8.5 mL of the diluted cDNA was used for qRT-PCR.

Quantitative RT-PCR was performed on cDNA (5 μL), using ×1 SYBR GREEN PCR master mix (Applied Biosystems), forward and reverse primers 0.3 μM each, and DDW was added up to 20 μL. qPCR reaction was performed in a Stratagene MX 3000 real-time PCR machine with the following conditions 50° C. for 2 min, 95° C. for 10 min, 40 times of 95° C. for 15 sec and 1 min at 60° C., followed by 95° C. for 15 sec, 60° C. for 60 sec, and 70 times of 60° C. for 10 sec +0.5° C. increase in each cycle. For each gene, a standard curve is prepared from a pool of RTs from all samples, in 5 dilutions (dilutions—1:60, 1:200, 1:600, 1:2000, 1:10000). The standard curve plot [ct (cycle threshold) vs. log (concentration)] should have R$>=$0.98 with an efficiency in the range of 100%+/−5%. The levels of expression (Qty) measured in the qPCR were calculated using the efficiency (E) of the amplification reaction and the corresponding C.T. (the cycle at which the samples crossed the threshold) Qty=$E^{-C.T.}$. The dissociation curves obtained were qualified for the absence of non-specific PCR products or primer-dimers. Reactions were repeated at least twice. The calculation method is based on the assumption that the efficiencies of the reactions of the GOI (gene of interest) and of the housekeeping genes are similar.

To normalize the expression level between the different tissues and growing conditions of maize plants, expression of each gene was divided by the geometric mean of the expression of the following four housekeeping genes: Actin (GenBank Acc No AY107106), and RPL19 (GenBank Acc. No. AY103679), Cyclophyllin (GenBank Acc No X68678) and Elongation factor 1 alpha (EF1A, GenBank Acc No AF136823).

TABLE 29

The following primers were used for qRT-PCR analysis:

| GENE | PRIMER/SEQ ID NO: |
|---|---|
| Actin FORWARD PRIMER: | CCTGACTGAACGCGGCTACT/ SEQ ID NO: 1344 |
| Actin Reverse primer: | CAATGGTGATGACCTGTCCGT/ SEQ ID NO: 1345 |
| RPL19 Forward primer: | GGAAAGGCAAAGTCTGGCTTG/ SEQ ID NO: 1346 |
| RPL19 Reverse primer: | GCACGGGACCTAGAGTGAACC/ SEQ ID NO: 1347 |
| Cyclophilin Forward primer: | GGACAGCTCTCCTAGATCTCTCTGA/ SEQ ID NO: 1348 |
| Cyclophilin Reverse primer: | CTAAACCGCTAAATTAAACTGCGAG/ SEQ ID NO: 1349 |
| EF1A Forward primer: | GTGAACATGCTCTCCTTGCGT/ SEQ ID NO: 1350 |
| EF1A Reverse primer: | ATTTGGGAGTGGTTGCATCC/ SEQ ID NO: 1351 |
| FUE_1 Forward Primer | ACTTCCACTGCGCGTAGATGA/ SEQ ID NO: 1352 |
| FUE_1 Reverse Primer | ACGGAATAATGACGATGAACCAC/ SEQ ID NO: 1353 |
| FUE_2 Forward Primer | CGAGCGACTCAAACCATGC/ SEQ ID NO: 1354 |
| FUE_2 Reverse Primer | TCTTGGTGATTGAATCCAGCG/ SEQ ID NO: 1355 |
| FUE_2_RT_2F | GCATGGTGGGTAAGGTTTTCTT/ SEQ ID NO: 1356 |
| FUE_2_RT_2R | CAATCTTGGTGATTGAATCCAGC/ SEQ ID NO: 1357 |
| FUE_3 Forward Primer | CACCATCCACGCACTAGTACGT/ SEQ ID NO: 1358 |
| FUE_3 Reverse Primer | CAGCTAGCCGCTTCGAGAGAT/ SEQ ID NO: 1359 |
| FUE_4 Forward Primer | AAGACGCCGATCGATACATTG/ SEQ ID NO: 1360 |

TABLE 29-continued

The following primers were used for qRT-PCR analysis:

| GENE | PRIMER/SEQ ID NO: |
|---|---|
| FUE_4 Reverse Primer | ACGTATTGAGTTCAGTTCTTCATGTGT/ SEQ ID NO: 1361 |
| FUE_5 Forward Primer | CCATTCAGAGGATATTTGGGTGA/ SEQ ID NO: 1362 |
| FUE_5 Reverse Primer | AATACTTGCGACCATGTCTATCCA/ SEQ ID NO: 1363 |
| FUE_6 Forward Primer | CCAGTCCACAATCTCCCTGCC/ SEQ ID NO: 1364 |
| FUE_6 Reverse Primer | GTCGTGCGCCTGGCCAAAG/ SEQ ID NO: 1365 |
| FUE_7 Forward Primer | CTGCGGTCAGAAATCTTATCGTC/ SEQ ID NO: 1366 |
| FUE_7 Reverse Primer | CGAACACAAAATCAGGCGTCT/ SEQ ID NO: 1367 |
| FUE_8 Forward Primer | CTTCCGGCTGGGTAAGTTTG/ SEQ ID NO: 1368 |
| FUE_8 Reverse Primer | ATGGTTCAGTGCCGTCTCCT/ SEQ ID NO: 1369 |
| FUE_9 Forward Primer | AAGAAGAAGCGACACAGCTCAAC/ SEQ ID NO: 1370 |
| FUE_9 Reverse Primer | GCAGCAGTAGGATGTGCGATC/ SEQ ID NO: 1371 |
| FUE_9_RT_2F | CAGCTCAACTGCTCAAGGACAG/ SEQ ID NO: 1372 |
| FUE_9_RT_2R | GGCGCAGCAGTAGGATGTG/ SEQ ID NO: 1373 |
| FUE_10 Forward Primer | CGATGCCTACAAGAACTACACCG/ SEQ ID NO: 1374 |
| FUE_10 Reverse Primer | AGTGGTTCTTGTCCGTGTTGAAG/ SEQ ID NO: 1375 |
| FUE_10_RT_2F | GCCGATGCCTACAAGAACTACAC/ SEQ ID NO: 1376 |
| FUE_10_RT_2R | TGAAGATGAGGAAATCCCCG/ SEQ ID NO: 1377 |
| FUE_12 Forward Primer | TCCTGTTACAGATGGCATCCG/ SEQ ID NO: 1378 |
| FUE_12 Reverse Primer | TCTCTCTCCTTAGTGAAGACGTTCG/ SEQ ID NO: 1379 |
| FUE_12_RT_2F | AGAATCTTATAAAGCCCTCACATCGT/ SEQ ID NO: 1380 |
| FUE_12_RT_2R | GATGACACGGGCGAACAGTA/ SEQ ID NO: 1381 |
| FUE_13 Forward Primer | CCGCCACCTTTCCTACGTAC/ SEQ ID NO: 1382 |
| FUE_13 Reverse Primer | TCGGTCTATACTCGATTCGAAGC/ SEQ ID NO: 1383 |
| FUE_14 Forward Primer | TCTGTGTTGCTGATATTCACTCTCCT/ SEQ ID NO: 1384 |
| FUE_14 Reverse Primer | CCTTACTCTTCATGGTGTCTCTAGCTT/ SEQ ID NO: 1385 |
| FUE_15 Forward Primer | GGCCGCCTGTTAGGAGCTA/ SEQ ID NO: 1386 |
| FUE_15 Reverse Primer | CGCCTCACTCCTACCTTCATCT/ SEQ ID NO: 1387 |
| FUE_16 Forward Primer | AAGAGGCAGTGCTGTTTCCGT/ SEQ ID NO: 1388 |
| FUE_16 Reverse Primer | GCCAGAATCGAGCATAGACCA/ SEQ ID NO: 1389 |
| FUE_17 Forward Primer | GCATCAAAGAGTGGTCAATTCACA/ SEQ ID NO: 1390 |
| FUE_17 Reverse Primer | CACCCTCCTTTGCAGTGCA/ SEQ ID NO: 1391 |
| FUE_30 Forward Primer: | CCAAGTCGTCTCTTAGTCCGGA/ SEQ ID NO: 1392 |
| FUE_30 Reverse Primer: | CAGGATGCACGTCTTGCCT/ SEQ ID NO: 1393 |
| FUE_31 Forward Primer: | ATGTGCAACGACCCTACTAACTCC/ SEQ ID NO: 1394 |
| FUE_31 Reverse Primer: | TCAGTGTCCTCAGCGCGAT/ SEQ ID NO: 1395 |
| FUE_32 Forward Primer: | CTCGAGCATCACTCAAACCACTAC/ SEQ ID NO: 1396 |
| FUE_32 Reverse Primer: | GCCAGGCCCATTGAATCAC/ SEQ ID NO: 1397 |
| FUE_33 Forward Primer: | CAGCGCTGTATGGTAAAGGTATTG/ SEQ ID NO: 1398 |
| FUE_33 Reverse Primer: | TGTGTCATGGAGGCTTGCC/ SEQ ID NO: 1399 |
| FUE_34 Forward Primer: | GCCACCAACTCCATTCAACTTT/ SEQ ID NO: 1400 |
| FUE_34 Reverse Primer: | CTCTTATTCATGGGCTTAATTGCA/ SEQ ID NO: 1401 |
| FUE_35 Forward Primer: | GACGCTCTGATTAGGCTAGGGAC/ SEQ ID NO: 1402 |
| FUE_35 Reverse Primer: | CCCTGCTGTTACGTGGCC/ SEQ ED NO: 1403 |
| FUE_36 Forward Primer: | TCAGTGAAGATGAGGCTCGCTA/ SEQ ID NO: 1404 |
| FUE_36 Reverse Primer: | TCCCATCTAGAAGTGTGTTCTCCA/ SEQ ID NO: 1405 |
| FUE_37 Forward Primer: | TGTGAGCATCAACTCTAACATGGA/ SEQ ID NO: 1406 |
| FUE_37 Reverse Primer: | TGACATAAATTTCACACATTCACATCA/ SEQ ID NO: 1407 |
| FUE_38 Forward Primer: | CTATGGAAATTTGTCACCGTGATC/ SEQ ID NO: 1408 |
| FUE_38 Reverse Primer: | TCGCAAATTTTCACACGAGGT/ SEQ ID NO: 1409 |
| FUE_39 Forward Primer: | CCGATGAGCTAGGAGAAGTGTTG/ SEQ ID NO: 1410 |

TABLE 29-continued

The following primers were used for qRT-PCR analysis:

| GENE | PRIMER/SEQ ID NO: |
|---|---|
| FUE_39 Reverse Primer: | TTTGGCCGATTGGGTATGTC/ SEQ ID NO: 1411 |
| FUE_40 Forward Primer: | ATTGCAGAGAGGGAAAACGTAAGA/ SEQ ID NO: 1412 |
| FUE_40 Reverse Primer: | AAATCAAACACGTCCAAGAACATC/ SEQ ID NO: 1413 |
| FUE_41 Forward Primer: | AAATATTTGTCCTATGGGAATGGG/ SEQ ID NO: 1414 |
| FUE_41 Reverse Primer: | AGTATAATAGTTCTGTCCAAAGTTGCGT/ SEQ ID NO: 1415 |
| FUE_42 Forward Primer: | GGTTGCGCGCTCTGACTTA/ SEQ ID NO: 1416 |
| FUE_42 Reverse Primer: | CCAACGACTCGCCTTCCTAAC/ SEQ ID NO: 1417 |
| FUE_43 Forward Primer: | CTTTGTAAACCAATGCCATCAGTTAG/ SEQ ID NO: 1418 |
| FUE_43 Reverse Primer: | GCTGGACTCTCTTCACTTCGCT/ SEQ ID NO: 1419 |
| FUE_44 Forward Primer: | GCACTGATCAATGCCGACTG/ SEQ ID NO: 1420 |
| FUE_44 Reverse Primer: | AAGGATTGGATCGGATACTTGTAGA/ SEQ ID NO: 1421 |
| FUE_45 Forward Primer: | TTATCCATGATACCCCGCTGA/ SEQ ID NO: 1422 |
| FUE_45 Reverse Primer: | GTGCTTGTTGACTTGACGACG/ SEQ ID NO: 1423 |
| FUE_46 Forward Primer: | AGCAGCCGCTGTGTATAACAAG/ SEQ ID NO: 1424 |
| FUE_46 Reverse Primer: | GGAAGGGAAAGAGGACGTCAA/ SEQ ID NO: 1425 |
| FUE_47 Forward Primer: | TGAACCTACTCTTTGGGATAGCTGT/ SEQ ID NO: 1426 |
| FUE_47 Reverse Primer: | ACGTGGAGAATTACATGCTGATAGTT/ SEQ ID NO: 1427 |
| FUE_48 Forward Primer: | ACCATTGTTAGTGACTTAATTACCCTCA/ SEQ ID NO: 1428 |
| FUE_48 Reverse Primer: | CGAAATCGATAGACCACACACG/ SEQ ID NO: 1429 |
| FUE_49 Forward Primer: | CCCTTCTACAAGCAAATACTCACTCC/ SEQ ID NO: 1430 |
| FUE_49 Reverse Primer: | GACCCTCTCATCTCTTATTGAACCA/ SEQ ID NO: 1431 |
| FUE_50 Forward Primer: | GGCGATCCAACGGAGAAGTAG/ SEQ ID NO: 1432 |
| FUE_50 Reverse Primer: | ACATCGGCAGCACGGAGT/ SEQ ID NO: 1433 |
| FUE_51 Forward Primer: | CCGGTGCATAAGGAAATACGAG/ SEQ ID NO: 1434 |
| FUE_51 Reverse Primer: | GACAGATTGAAAACTGCCCCAG/ SEQ ID NO: 1435 |
| FUE_52 Forward Primer: | GTCGATCATCGCATTCTCCA/ SEQ ID NO: 1436 |
| FUE_52 Reverse Primer: | TCCTTTCATCGTATCCCCCAT/ SEQ ID NO: 1437 |
| FUE_53 Forward Primer: | CAGATCTTCTTCTCTCAGCTCCCT/ SEQ ID NO: 1438 |
| FUE_53 Reverse Primer: | GGGCTGAATCAACGTCGACT/ SEQ ID NO: 1439 |
| FUE_54 Forward Primer: | GAAGCTGTGGGTCTCAAGGG/ SEQ ID NO: 1440 |
| FUE_54 Reverse Primer: | AGGTCGGCACGTACTCGG/ SEQ ID NO: 1441 |
| FUE_55 Forward Primer: | TCTACATCCAGGCTCTCGTTAGC/ SEQ ID NO: 1442 |
| FUE_55 Reverse Primer: | TTCATCTTCATCAGTAAGACCATCATC/ SEQ ID NO: 1443 |

Results

Figure 3A:
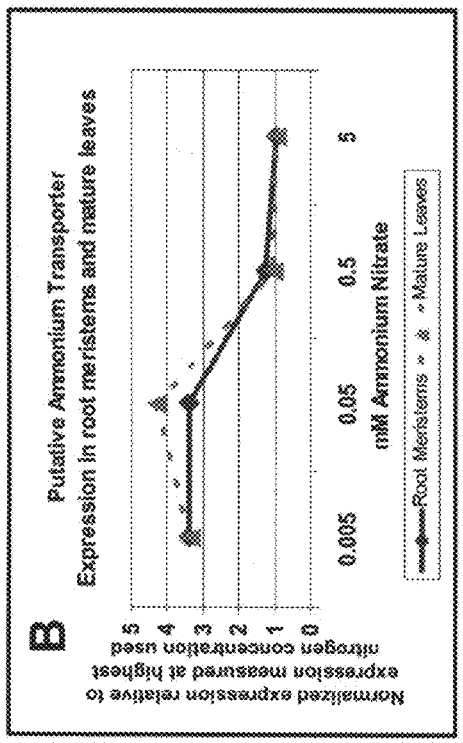
Figure 3B:
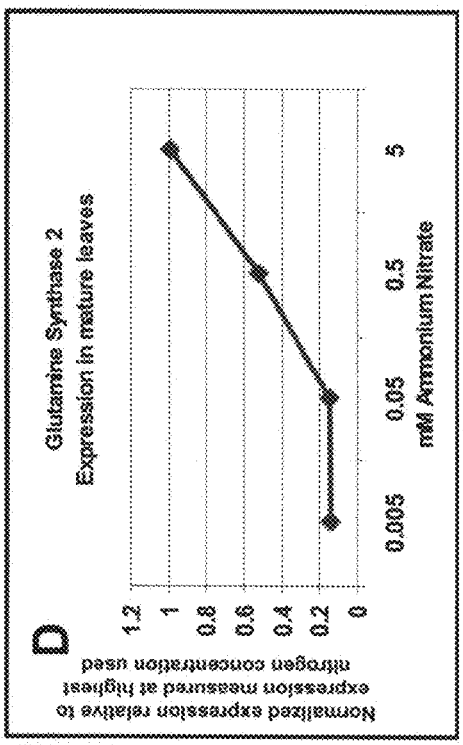
Figure 3C:
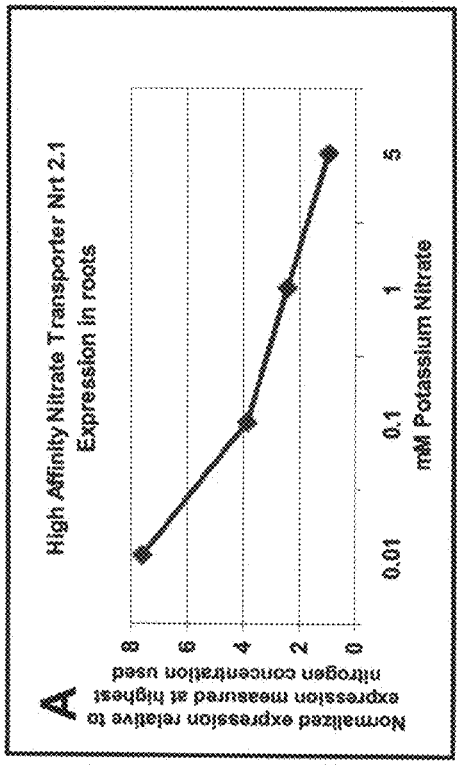
Figure 3D:
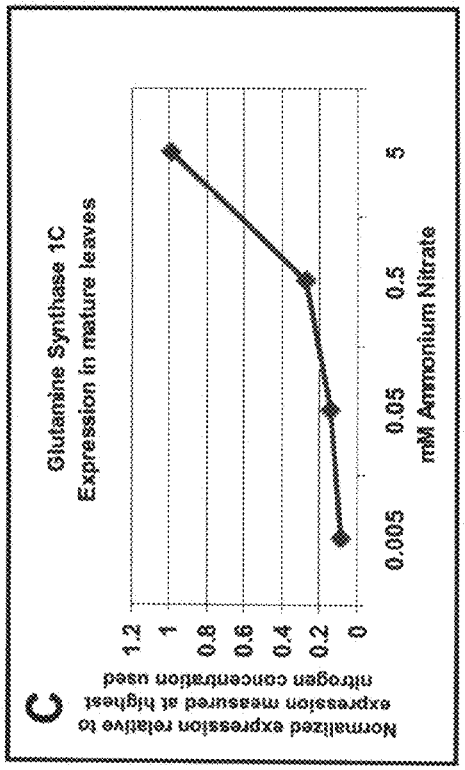
Figure 4A:
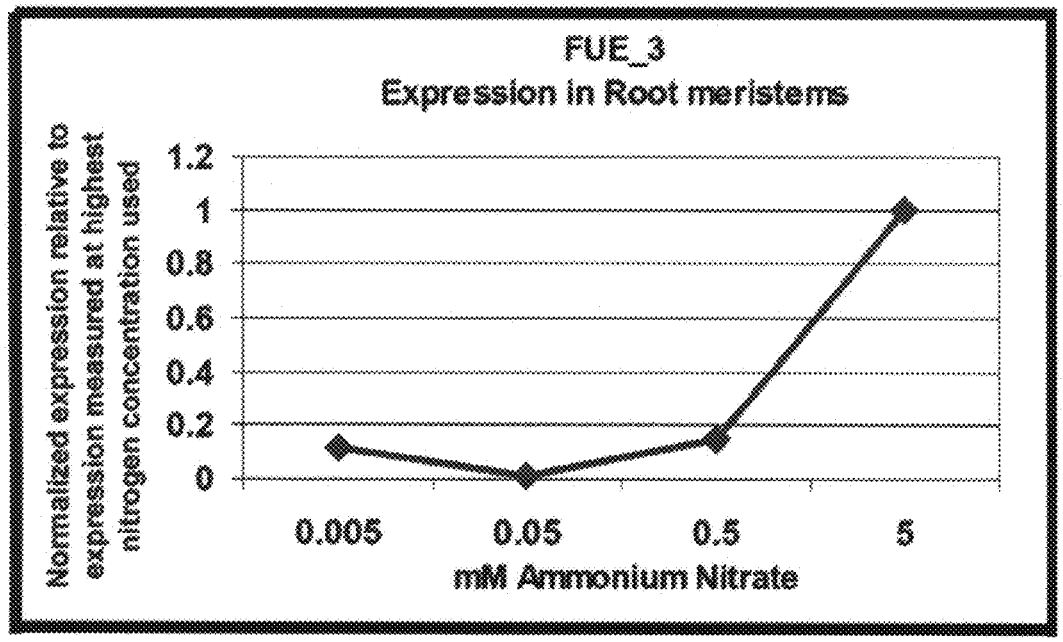
Figure 4B:
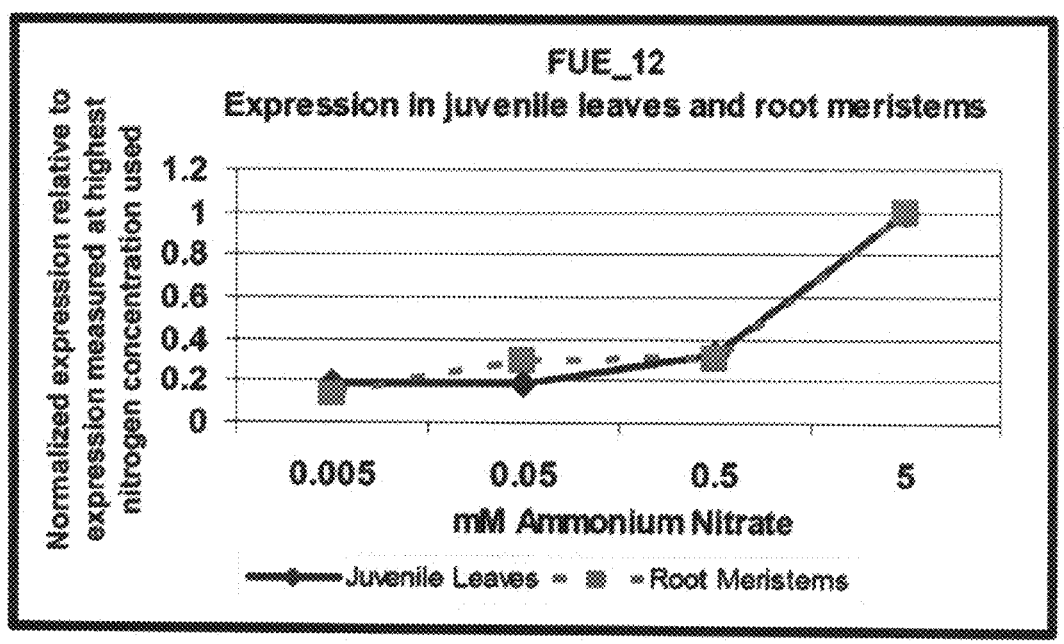

Real-time RT-PCR analysis provided evidence that the in-silico selected polynucleotide sequences are indeed associated with Nitrogen Use. Although the majority of the genes were chosen because of their association with drought, genes were found to be responsive to the Nitrogen status within the plant suggesting a cross-talk between drought and nutrient deficiency stress. Evidence that the RNA panel used in this assay does reflect genuine changes associated to the nitrogen status can be found FIGS. 3A-D in which known genes associated to nitrogen uptake and assimilation show changes in their expression levels according to the nitrogen fertilizer level used in the irrigation solution. The graphs represent the normalized expression levels found for each gene divided by the level of expression at the highest nitrogen fertilizer concentration used in the irrigation solution. FIGS. 3A and 3B show the results found for two high affinity nitrate and ammonium transporter respectively. As expected, at higher concentrations of the substrate, the expression of the high affinity transporters is downregulated. Conversely, those high affinity transporters, obviously essential at conditions in which the substrate is scarce, are upregulated at low nitrate and ammonium concentrations (see FIGS. 3A and 3B). As expected for two key enzymes in the nitrogen assimilation pathway such as Glutamine Synthase 1C and Glutamine Synthase 2, their expression is upregulated under high substrate conditions as shown in FIGS. 3C and 3D, respectively. Typically, low affinity transporters are upregulated with high N concentration. Conversely, high affinity transporters are upregulated with low N concentration. Enzymes involved in N-assimilation (the conversion of n to amino acids) are upregulated inn the presence of nitrogen. The genes identified in Example 1 show the distinctive nitrogen responsive behavior found for the control genes (FIGS. 3A-D). FUE_3 (as shown in FIG. 4A) shows upregulation at high substrate concentrations as found for the key control assimilation enzymes indicating a clear association of this gene with the nitrogen status of the plant and hence its relation to nitrogen related-responses. The same upregulation found for FUE_3 was found several other genes included in Example 1 such as FUE_12 (as shown in FIG.

Figure 4C:
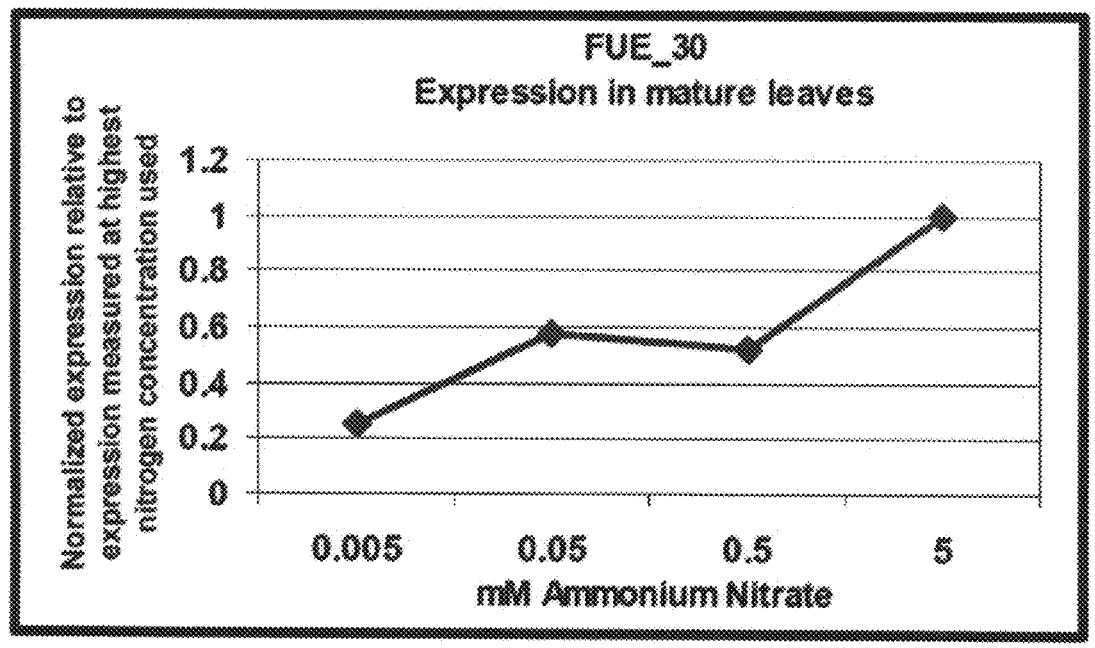
Figure 4D:
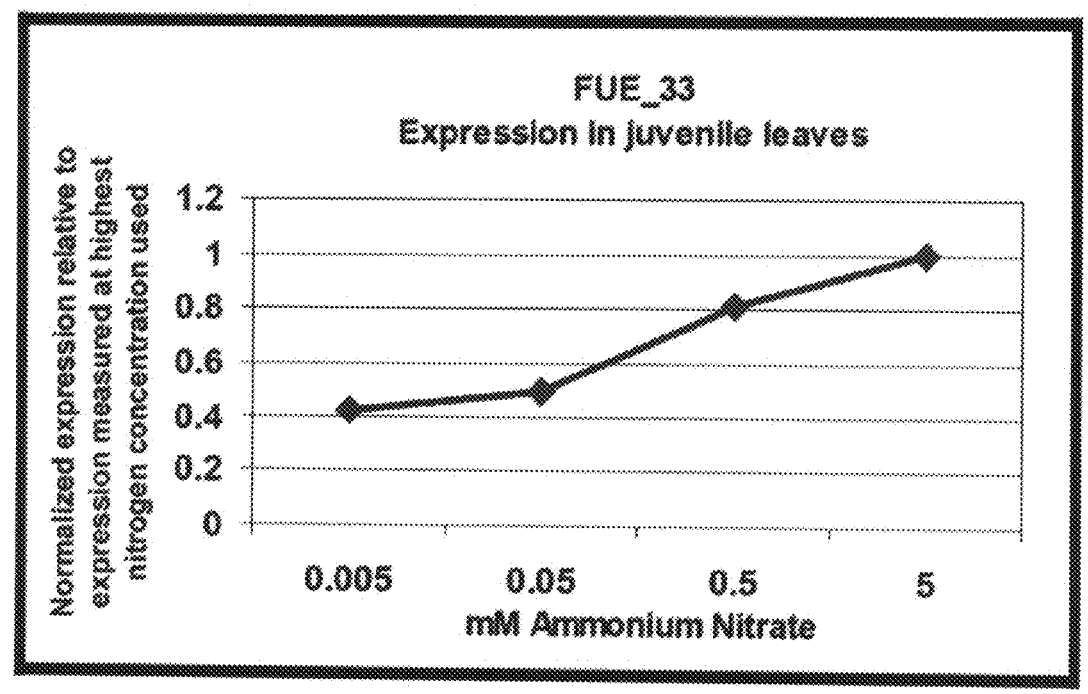
Figure 4E:
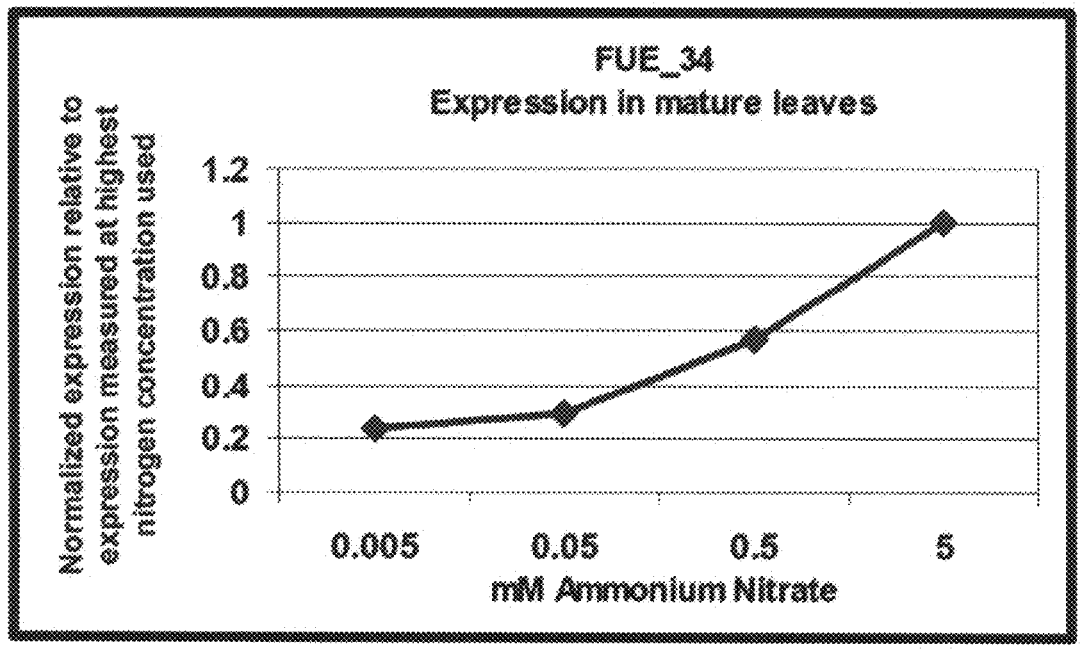
Figure 4F:
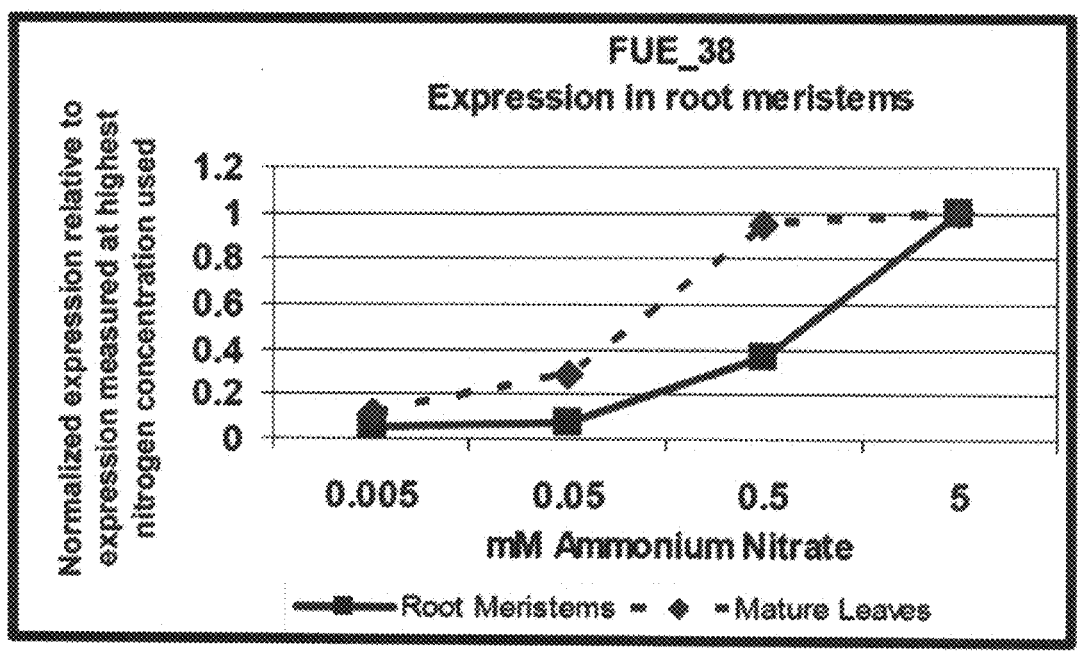
Figure 4G:
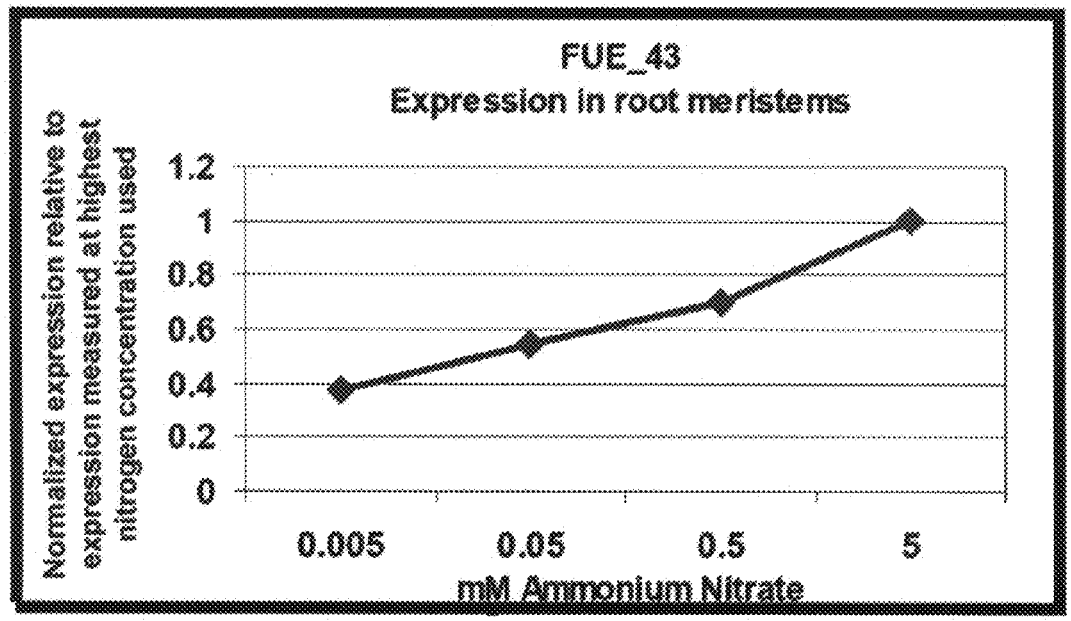
Figure 4H:
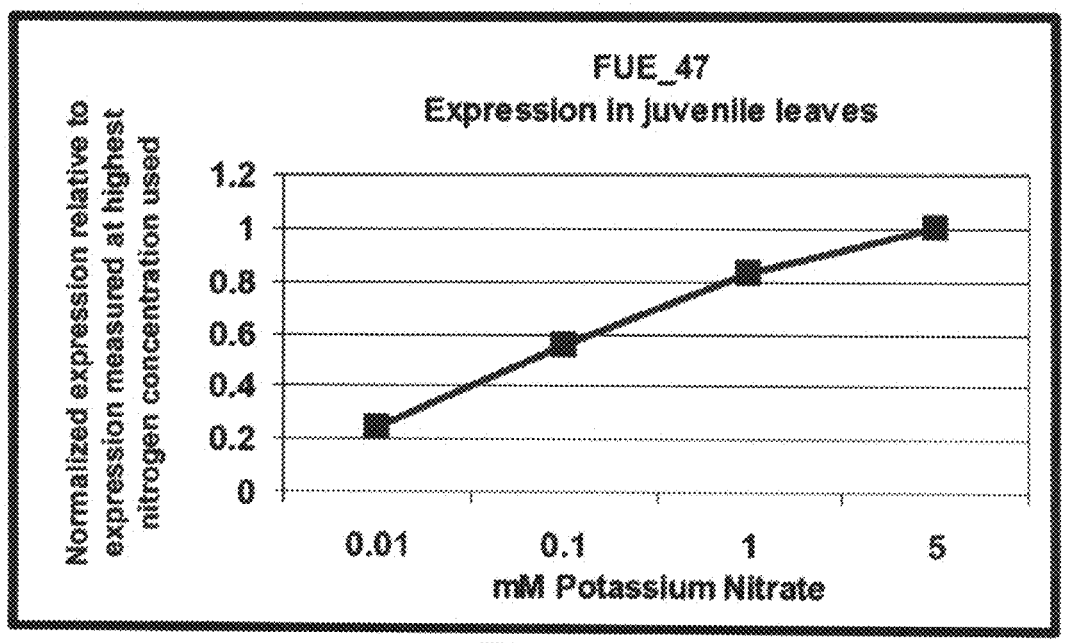
Figure 4I:
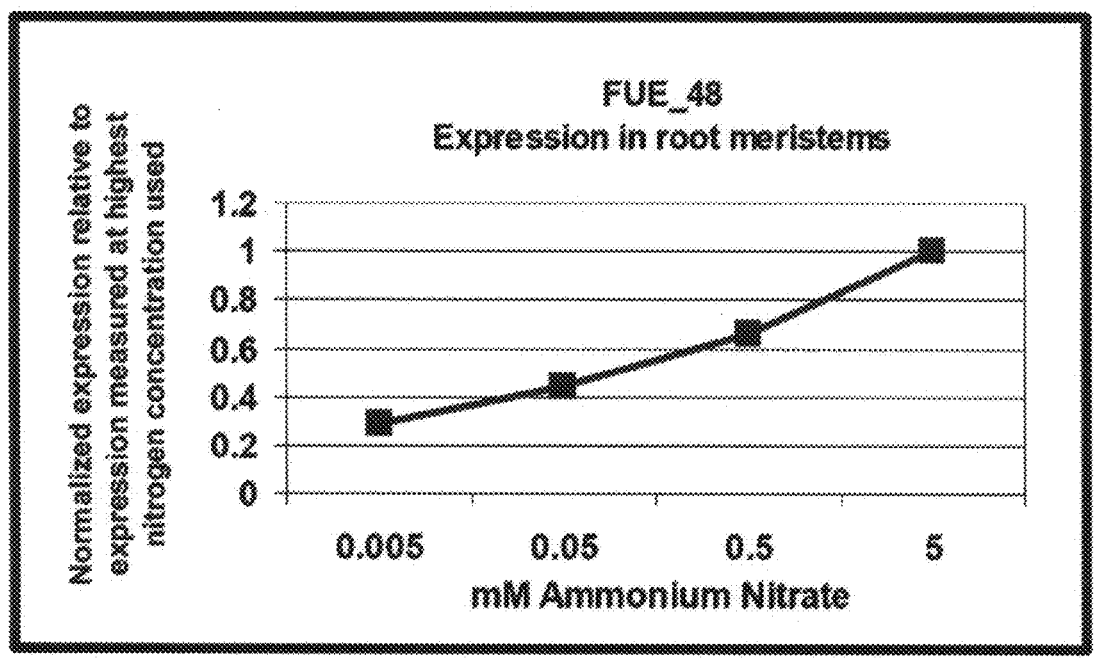
Figure 4J:
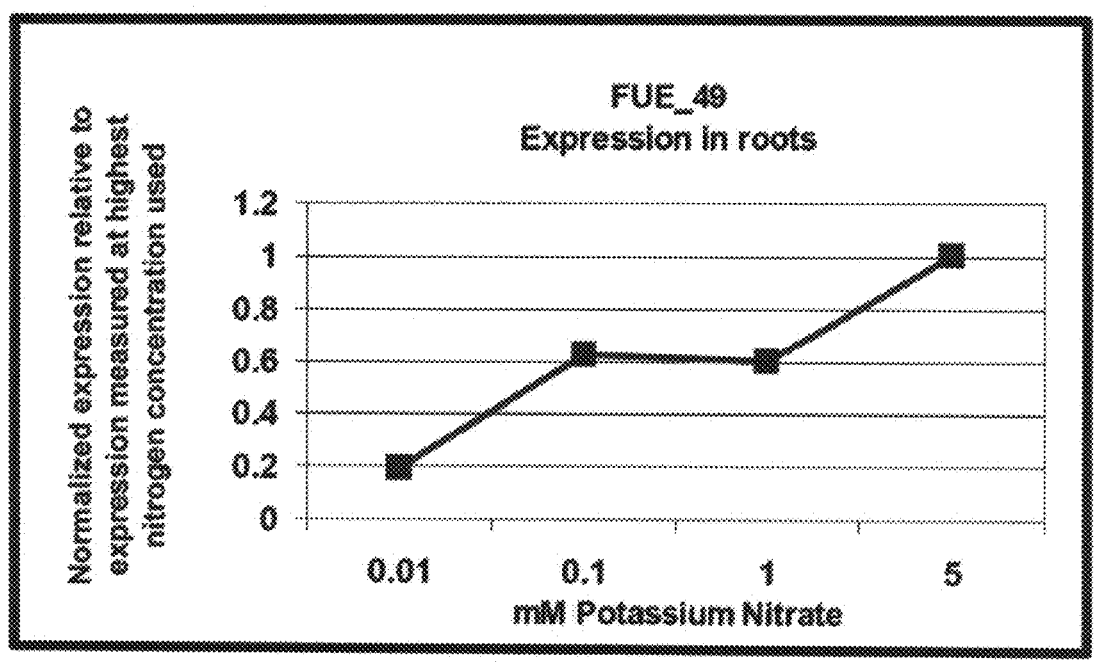
Figure 4K:
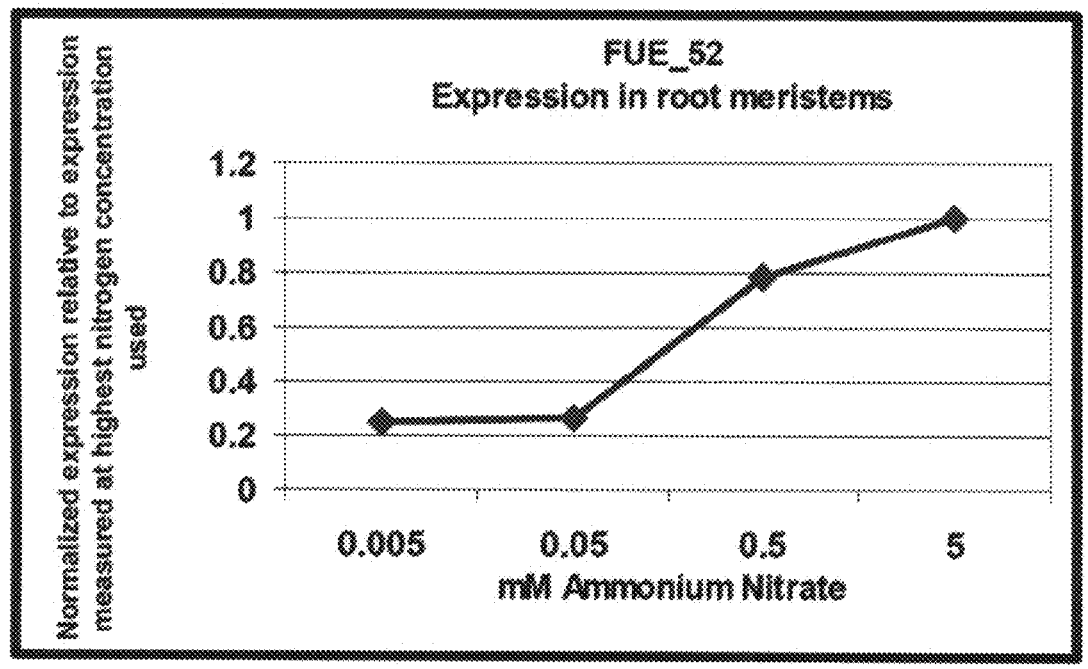

4B), FUE_30 (as shown in FIG. 4C), FUE_33 (as shown in FIG. 4D), FUE_34 (as shown in FIG. 4E), FUE_38 (as shown in FIG. 4F), FUE_43 (as shown in FIG. 4G), FUE_47 (as shown in FIG. 4H), FUE_48 (as shown in FIG. 4I), FUE_49 (as shown in FIG. 4J) and FUE_52 (as shown in FIG. 4K).

Figure 5A:
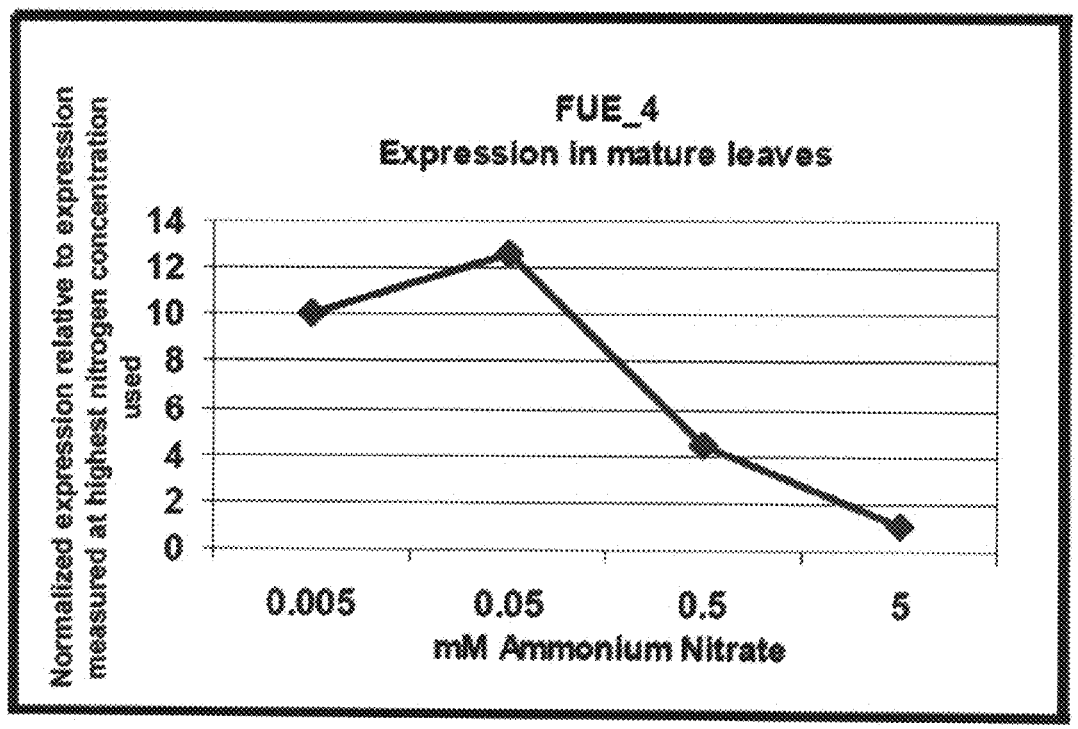
Figure 5B:
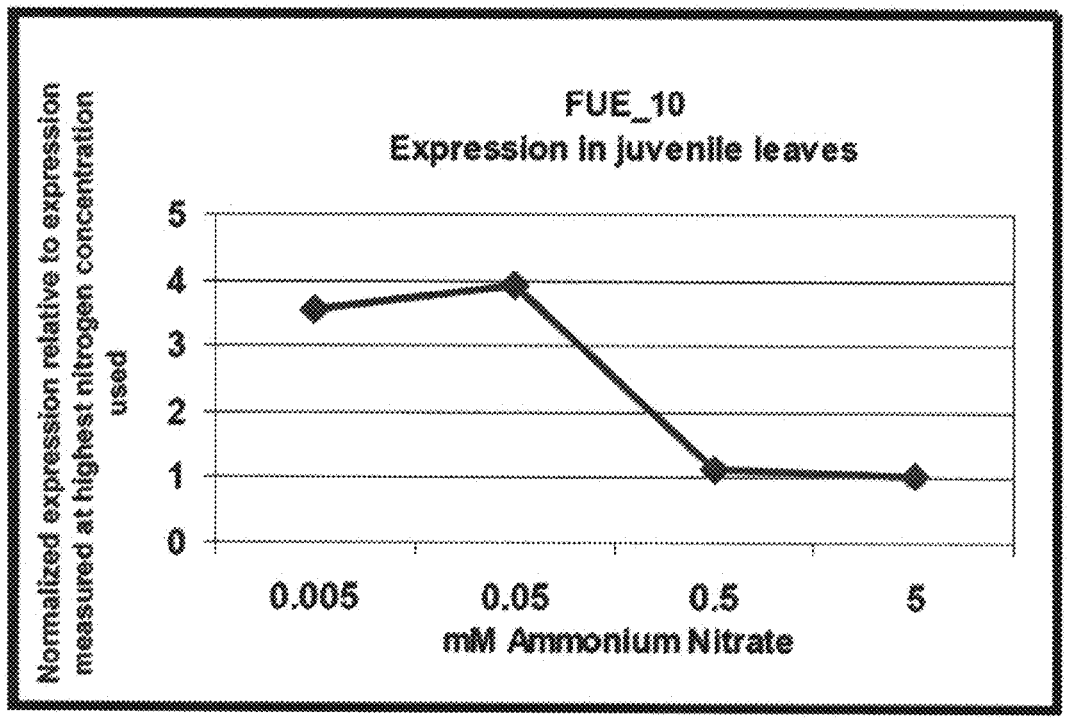
Figure 5C:
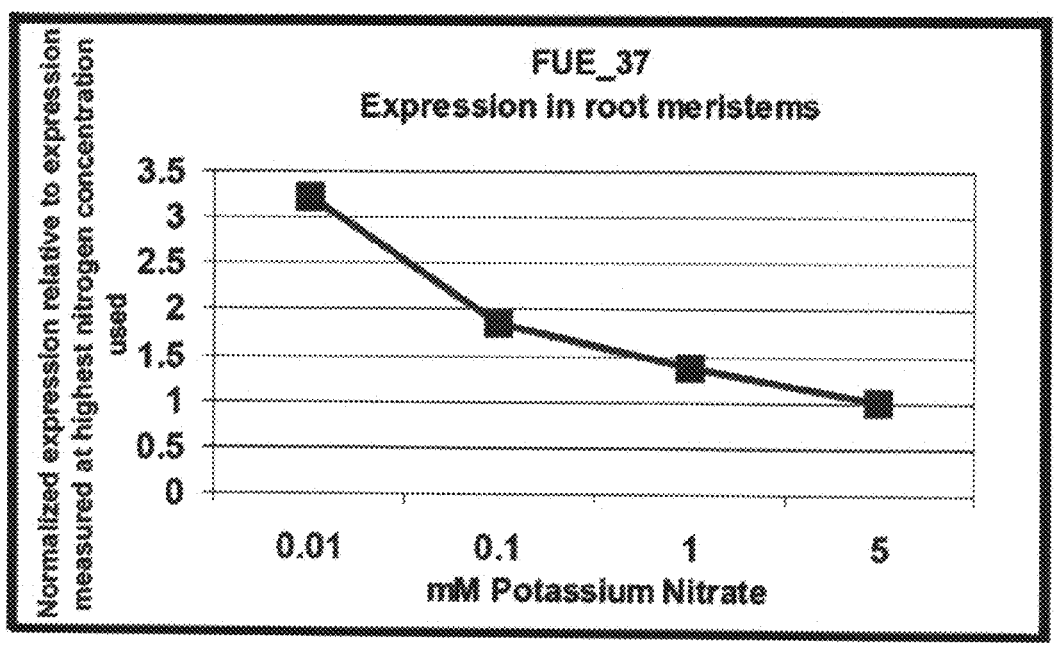
Figure 5D:
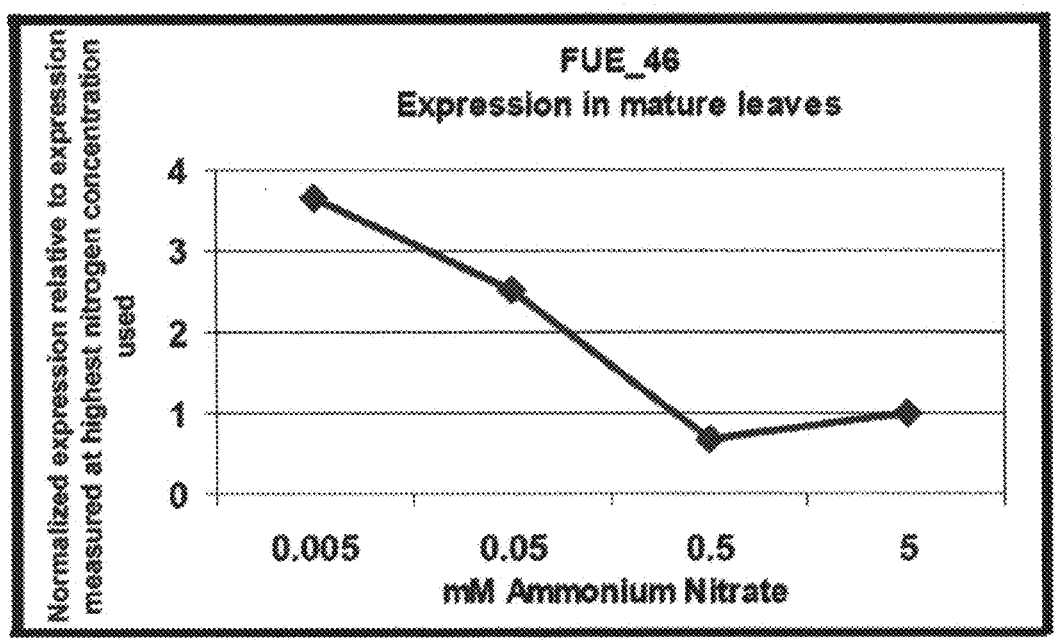
Figure 5E:
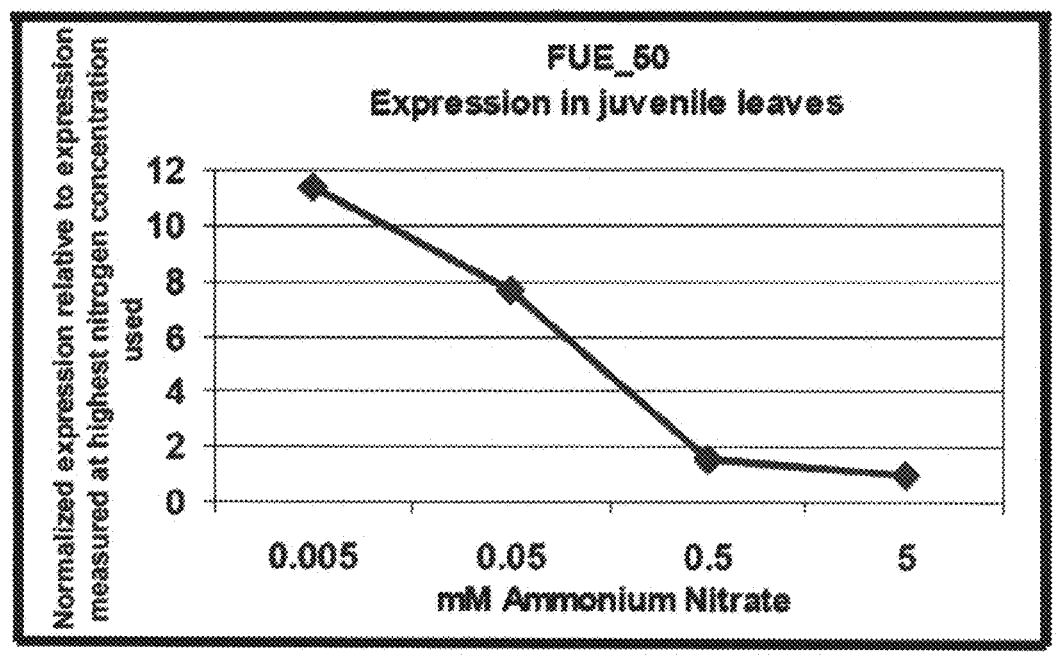

Then again, included in Example 1 are genes that show a tight upregulation when nitrogen fertilizer is in short supply. This kind of genes is expected to be related to pathways involved in nitrogen assimilation, storage and use under conditions of nitrogen deficiency as is the case of the high affinity nitrate and ammonium transporters (FIGS. 2C and 2D). FIG. 5A shows the results for FUE_4, a gene that undergoes a strong upregulation at low nitrogen fertilizer availability, indicating a clear role of this gene in the plant endogenous response to nitrogen deficient conditions. Likewise, other genes in Example 1, display a similar nitrogen-responsiveness curve as FUE_4 such as FUE_10 (as shown in FIG. 5B), FUE_37 (as shown in FIG. 5C), FUE_46 (as shown in FIG. 5D) and FUE_50 (as shown in FIG. 5E).

Taken together, the results presented herein clearly imply a close correlation between the in-silico selected genes and nitrogen associated pathways.

Example 3

Gene Cloning and Creation of Binary Vectors For Plant Expression

Cloning Strategy

Twenty eight genes of the 50 genes selected in Example 1 and validated in Example 2 above were cloned into binary vectors for the generation of transgenic plants. For cloning, the full-length open reading frame (ORF) was first identified. EST clusters and in some cases mRNA sequences were analyzed to identify the entire open reading frame by comparing the results of several translation algorithms to known proteins from other plant species. In case where the entire coding sequence was not found, RACE kits from Ambion or Clontech (RACE=Rapid Access to cDNA Ends) were used to prepare RNA from the plant samples described in Example 2 above to thereby access the full cDNA transcript of the gene.

In order to clone the full-length cDNAs, Reverse Transcription followed by PCR (RT-PCR) was performed on total RNA extracted from leaves, roots or other plant tissues, growing under either normal or nutrient deficient conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) and are basic for those skilled in the art. PCR products were purified using PCR purification kit (Qiagen) and sequencing of the amplified PCR products is performed, using ABI 377 sequencer (Applied Biosystems).

To facilitate cloning of the cDNAs, a 8-12 bp extension was added to the 5' prime end of each primer. The primer extension includes an endonuclease restriction site. The restriction sites are selected using two parameters: a. The site does not exist in the cDNA sequence. b. The restriction sites in the forward and reverse primers are designed so the digested cDNA is inserted in the sense formation into the binary vector utilized for transformation. For instance, the pPI plasmid vector was constructed by inserting a synthetic poly-(A) signal sequence, originating from pGL3 basic plasmid vector (Promega, Acc. No. U47295; bp 4658-4811) into the HindIII restriction site of the binary vector pBI101.3 (Clontech, Acc. No. U12640).

PCR products were purified (PCR Purification Kit, Qiagen, Germany) and digested with the restriction sites according to the primers used (Roche, Switzerland). The digested PCR products were cloned into the binary vector pPI, which was digested with the same restriction enzymes. The digested PCR product and the linearized plasmid vector were ligated using T4 DNA ligase enzyme (Roche, Switzerland). The following genes were cloned from RNA extracted from the tissues described above using the following primers:

TABLE 30 genes cloned from cDNA libraries and the primers used for the cloning

| Gene Name | Restriction Enzymes used for cloning | Primers used for amplification/ SEQ ID NO: |
|---|---|---|
| FUE_501 | SmaI, EcoRv | Fwd-AACCCGGGAACAATGACACCACAGATCAAAACTCA/ SEQ ID NO: 1444 Rev-AGGATATCATATGAATGCTACGGCAAGC/ SEQ ID NO: 1445 |
| FUE_502 | SmaI, SacI | Fwd-AAACCCGGGAACAATGAGGTACGATCAGGAAGCGG/ SEQ ID NO: 1446 Rev-TTGAGCTCGTTCGCTGGAGGTAACAATG/ SEQ ID NO: 1447 |
| FUE_503 | SmaI, EcoRv | Fwd-AACCCGGGAACAATGGATCAAAAGTTAGACAGTT/ SEQ ID NO: 1448 Rev-TTGATATCCACAAAACTCTCTAGCTCCTGAC/ SEQ ID NO: 1449 |
| FUE_504 | XbaI, SacI | Fwd-AAACCCGGGAACAATGGAGGACAAGAACAATGATAAG/ SEQ ID NO: 1450 Rev-TTGAGCTCGGGTCTCTTTGTCATGGAGTTC/ SEQ ID NO: 1451 |
| FUE_33 | SmaI, SacI | Fwd-CTCCCGGGAACAATGGCTCTCGTGACCTCGG/ SEQ ID NO: 1452 Rev-TTGAGCTCCGCAACACAGTTTCATGACCA/ SEQ ID NO: 1453 |

TABLE 30-continued genes cloned from cDNA libraries and the primers used for the cloning

| Gene Name | Restriction Enzymes used for cloning | Primers used for amplification/ SEQ ID NO: |
|---|---|---|
| FUE_34_Evo | XbaI, EcoRv | Fwd-GGTCTAGAAACAATGGGGAGGGGAAAGAT/ SEQ ID NO: 1454<br>Rev-CGGGATATCATAAGACGCCAGTTTTACTCTTATTCATGGGC/ SEQ ID NO: 1455 |
| FUE_34_Pat | XbaI, EcoRv | Fwd-GGTCTAGAAACAATGGGGAGGGGAAAGAT/ SEQ ID NO: 1456<br>Rev-CGGGATATCATAAGACGCCAGTTTTACTCTTATTCATGGGC/ SEQ ID NO: 1457 |
| FUE_39 | XbaI, SacI | Fwd-AATCTAGAATGGTGGACTTTGTTCGAcGG/ SEQ ID NO: 1458<br>Rev-CTGAGCTCACAGGAGGACATGCCACC/ SEQ ID NO: 1459 |
| FUE_43 | XbaI, SacI | Fwd-CATCTAGAAACAATGGCGGACTCGTCGGCG/ SEQ ID NO: 1460<br>Rev-TTGAGCTCGCAGTGTGCAAGAGTTCCCTC/ SEQ ID NO: 1461 |
| FUE_50 | XbaI, EcoRv | Fwd-AATCTAGAGTAATAAGCCAACAAACAAACCG/ SEQ ID NO: 1462<br>Rev-CAGATATCCTAGCATACCGACCCTGAAAACAC/ SEQ ID NO: 1463 |

Synthetic sequences of some of the cloned polynucleotides were ordered from a commercial supplier (GeneArt, GmbH). The synthetic DNA was designed in silico, based on the putative encoded polypeptide sequences described in Example 1.

To optimize the coding sequence, codon-usage tables calculated from plant transcriptomes were used (example of such tables can be found in the Codon Usage Database available online at Hypertext Transfer Protocol://World Wide Web (dot) kazusa (dot) or (dot) jp/codon/). The optimized coding sequences were designed in a way that no changes are introduced in the encoded amino acid sequence while using codons preferred for expression in dicotyledonous plants mainly tomato and Arabidopsis; and monocotyledonous plants such as maize. Such optimized sequences promote better translation rate and therefore higher protein expression levels. To the optimized sequences flanking additional unique restriction enzymes sites were added- SalI, XbaI, BamHI, SmaI at the 5' end and SadI at the 3' end. The genes for which codon optimized synthetic sequences were prepared were: FUE_2 (SEQ ID NO: 1317), FUE_3, (SEQ ID NO: 1319) FUE_4 (SEQ ID NO: 1320), FUE_40 (SEQ ID NO: 1321), FUE_7 (SEQ ID NO: 1322), FUE_8 (SEQ ID NO: 1324), FUE_9 (SEQ ID NO: 1325), FUE_10 (SEQ ID NO: 1326), FUE_12 (SEQ ID NO: 1327), FUE_13 (SEQ ID NO: 1328), FUE_14 (SEQ ID NO: 1329), FUE_16 (SEQ ID NO: 1330), FUE_37 (SEQ ID NO: 1331), FUE_41 (SEQ ID NO: 1332), FUE_46 (SEQ ID NO: 1333), FUE_47 (SEQ ID NO: 1334), FUE_49 (SEQ ID NO: 1335), FUE_52 (SEQ ID NO: 1336). Two non-optimized sequences, designated "FUE_2_Original" (SEQ ID NO: 1318) and "FUE_7_Original" (SEQ ID NO: 1323), identical to their endogenous maize sequences were synthesized and cloned for overexpression in transgenic plant creation.

Generation of binary vectors comprising FUE genes and plant functional promoters for driving expression of same—The plasmid pPI was constructed by inserting a synthetic poly-(A) signal sequence, originating from pGL3 basic plasmid vector (Promega, Acc No U47295; bp 4658-4811) into the HindIII restriction site of the binary vector pBI101.3 (Clontech, Acc. No. U12640). In some cases the backbone binary plasmid used was pGI which is similar to pPI but the GUS gene was replaced by the GUS-Intron gene (Vancanneyt. G, et al MGG 220, 245-50, 1990). pGI was used to clone all the polynucleotide sequences, initially under the control of 35S promoter [Odell, J T, et al. Nature 313, 810-812 (28 Feb. 1985); SEQ ID NO: 1337].

Some polynucleotide sequences were cloned under other preferential promoters as described below. One of the promoters, named here "RootP" (SEQ ID NO: 1338) because of its enriched expression in roots, was amplified and cloned from genomic DNA isolated from Arabidopsis thaliana by direct PCR using the following primers.

TABLE 31

| Primer name | Primer sequence/SEQ ID NO: |
|---|---|
| Root_P Forward (Enzyme SalI) | TATGTCGACTCAGATGAAGAAGGCGGCT/ SEQ ID NO: 1464 |
| Root_P Reverse (Enzyne SmaI) | GTCCCGGGTTTATTAGATCTCTCTAGGAGTTTTGA/ SEQ ID NO: 1465 |

The promoter is the 1110 bp upstream region of the gene ATXTH19 (AT4G30290, Xyloglucan endotransglucosylase/hydrolase 19). The sequence cloned was already shown to drive root-specific expression (Vissenberg K, et al. Plant Cell Physiol. 2005 January; 46(1):192-200). The following genes were cloned downstream of the RootP promoter sequence: FUE_3, FUE_4, FUE_8, FUE_9, FUE_13, FUE_14, FUE_16, FUE_33, FUE_34_Evo. For control purposes, the β-glucuronidase enzyme (GUS) encoded by the uid A gene (GENBANK ACCESSION NO: S69414).

The TT105 promoter (SEQ ID NO: 1339; 2004/081173) was used to mediate constitutive ubiquitous expression at levels different from those mediated by the 35S promoter. The promoter TT105 contains the upstream region of the ELP gene (Ectopic deposition of Lignin, GENBANK ACCESSION NO: NM_100466, AT1G05850) including the first exon and part of the first intron. The genes cloned under the TT105 promoter were FUE_502, FUE_504, FUE_39 and FUE_52. Here again the β-glucuronidase enzyme (GUS) encoded by the uid A gene was cloned under the TT105 promoter.

Example 4

Generation of Transgenic Plants Expressing the FUE Genes

Materials and Methods

Arabidoposis transformation—was effected according to Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (20000 Female reproductive tissues are the primary targets of *Agrobacterium*-mediated transformation by the *Arabidopsis* floral-dip method. Plant Physiol. 123(3): 895-904.). Briefly *Arabidopsis thaliana* var *Columbia* ($T_0$ plants) were transformed using the Floral Dip procedure described by Clough S J and Bent A F (10) and by Desfeux C et al. (11), with minor modifications. Briefly, *Arabidopsis thaliana* Columbia (Col0) $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hr light/dark cycles. The $T_0$ plants were ready for transformation six days prior to anthesis. Single colonies of *Agrobacterium* carrying the binary vectors harboring the FUE genes were cultured in LB medium supplemented with kanamycin (50 mg/L) and gentamycin (50 mg/L). The cultures were incubated at 28° C. for 48 hrs under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the flowering stem was submerged for 3-5 seconds. Each inoculated $T_0$ plant was immediately placed in a plastic tray, then covered with clear plastic dome to maintain humidity and kept in the dark at room temperature for 18 hrs to facilitate infection and transformation. Transformed (transgenic) plants are then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating T1 and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% Triton X-100 for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants. At least 10 independent transformation events were created from each construct for which bulk of T2 seeds were collected.

Maize transformation—This procedure is done according to (Bronwyn R: Frame, et al, Agrobacterium tumefaciens-Mediated Transformation of Maize Embryos Using a Standard Binary Vector System, Plant Physiology, May 2002, Vol. 129, pp. 13-22) or to the several protocols available elsewhere from the Plant Transformation Facility at Iowa State University (Hypertext Transfer Protocol://World Wide Web (dot) agron (dot) iastate (dot) edu/ptf/Web/mainframe (dot) htm).

Example 5

Selection of Transgenic *Arabidopsis* Plants Expressing the FUE Genes According to Expression Level Materials and Methods Transgenic plants were grown as detailed in Example 4 above. Total RNA was extracted from 10 freshly excised flowers from the transgenic plants as detailed in Example 2 above. In order to determine the relative expression level of the transgene qRT-PCR reactions were performed as described in Example 2 above and the results were normalized against the geometric mean of the expression of two housekeeping genes measured in the same samples.

TABLE 31

Primers used for selection of transgenic plants

| PRIMER NAME | PRIMER SEQUENCE/SEQ ID NO: |
|---|---|
| NUE10_RT_F | CCACTCTGTGGTTCAGACTAGGAAC/ SEQ ID NO: 1466 |
| NUE10_RT_R | CATTCAACAGTATCATCTGGCCC/ SEQ ID NO: 1467 |
| NUE16_RT_F | CAGGATGGTCTAGTGGAGTGGAT/ SEQ ID NO: 1468 |
| NUE16_RT_R | GCAGAGTACTGGAACACAAGGTTATC/ SEQ ID NO: 1469 |
| NUE41_RT_F | CGTAAGAGAGTGGGACTTACTGGAT/ SEQ ID NO: 1470 |
| NUE41_RT_R | CCATGCCTATCAGAGTACCTGTGA/ SEQ ID NO: 1471 |
| FUE501_RT_F | GTCCTGCGTAGACGAGTCGAA/ SEQ ID NO: 1472 |
| FUE501_RT_R | AGCTTATGACAACAAATAGAACCGC/ SEQ ID NO: 1473 |
| NUE50_RT_F | GCCACCATTGTACTCGTCCC/ SEQ ID NO: 1474 |
| NUE50_RT_R | GAAGCCCGTCAGTCCAAGG/ SEQ ID NO: 1475 |

TABLE 31-continued

Primers used for selection of transgenic plants

| PRIMER NAME | PRIMER SEQUENCE/SEQ ID NO: |
|---|---|
| NUE50_RT2_F | CCAGTGCATGTACTACCAAGGG/ SEQ ID NO: 1476 |
| NUE50_RT2_R | CTAGGCCGACTGATGCCG/ SEQ ID NO: 1477 |
| FUE501_RT2_F | ACTTACGCCGGAGTTATGAAAGAG/ SEQ ID NO: 1478 |
| FUE501_RT2_R | AAAAGTAGCAACCATCGTAGCAATC/ SEQ ID NO: 1479 |
| FUE502_RT_751F | CTAGAGGCTAAATACAAAGACAAGTTCG/ SEQ ID NO: 1480 |
| FUE502_RT_831R | GAACGCACCGTACATGATCG/ SEQ ID NO: 1481 |
| FUE503_RT_349F | TTATCTTTATCTACTGGTGCGTTATTGC/ SEQ ID NO: 1482 |
| FUE503_RT_430R | ACGTCGAATGAGGCTTACACG/ SEQ ID NO: 1483 |
| FUE 504_RT_296F | CCAGCAGAAGTAATTTAGATGTTGAGTC/ SEQ ID NO: 1484 |
| FUE 504_RT_431R | CCACCAATGGGCAATTCC/ SEQ ID NO: 1485 |
| NUE39_RT2_f | GATAAGGAGGAATGGCGCAG/ SEQ ID NO: 1486 |
| NUE39_RT2_R | GCATCCTCTACTTGAGAGTTGAACAC/ SEQ ID NO: 1487 |
| NUE3_RT_F | CAACTTACTCCATGCGCTGGT/ SEQ ID NO: 1488 |
| NUE3_RT_R | GGCTGTTGTTCCTTAAGCCTAGAG/ SEQ ID NO: 1489 |
| NUE4_RT_F | ATGTTGTTTGGCCAGCAGGT/ SEQ ID NO: 1490 |
| NUE4_RT_R | AAGTGGAACAGCGTGTGCTCT/ SEQ ID NO: 1491 |
| NUE49_RT_F | CCACAATCTTACCGTGAGACCA/ SEQ ID NO: 1492 |
| NUE49_RT_R | GTACTTAGAGGTAGATGACCCGAGGT/ SEQ ID NO: 1493 |
| NUE13_RT_F | TGAGAGAATGTGGAAGGTTGCAT/ SEQ ID NO: 1494 |
| NUE13_RT_R | TCATGGTAGTCACAGATCCTGGTC/ SEQ ID NO: 1495 |
| NUE2-Original_F | AGTGTTCGTCCTCCCAGCAC/ SEQ ID NO: 1496 |
| NUE2-Original_R | CCTGCCTTTTCTGGATGTCAAC/ SEQ ID NO: 1497 |
| NUE7_RT_F | TTCTCAACAGGGTGATGATGCT/ SEQ ID NO: 1498 |
| NUE7_RT_R | GTCTGAACAGTCTTGGTAACAGTCTCTT/ SEQ ID NO: 1499 |
| NUE7_Original_RT_F | TTGTGTTGGGCGTGAGCA/ SEQ ID NO: 1500 |
| NUE7_Original_RT_R | GGGAGGTGGAAGCAAGGC/ SEQ ID NO: 1501 |
| NUE9_RT_F | AATGGCTTTCGAGGGACCA/ SEQ ID NO: 1502 |
| NUE9_RT_R | GGAGAACAAAGTAGATCTGCCCA/ SEQ ID NO: 1503 |
| G3PD_RT_F | CCTTGACATTGTTTCCAACGCTA/ SEQ ID NO: 1504 |
| G3PD_RT_R | GACAGTGGTCATGAGTCCCTCA/ SEQ ID NO: 1505 |
| UBQ4_RT_F | CTTCTGAGCTTTTGTGATGTGATCA/ SEQ ID NO: 1506 |
| UBQ4_RT_R | ATAAGTTTTTCCCGCAGACCG/ SEQ ID NO: 1507 |
| NUE52_RT_F | AGCCAAAGACCTTCGCTAACG/ SEQ ID NO: 1508 |
| NUE52_RT_R | CCAGTCCTAGAGAAAGTGTATGGGA/ SEQ ID NO: 1509 |
| GUS_RT2_F | GTGTGGGTCAATAATCAGGAAGTG/ SEQ ID NO: 1510 |
| GUS_RT2_R | AATAACATACGGCGTGACATCG/ SEQ ID NO: 1511 |

Results

About twelve transgenic events were screened for each construct. The results were highly repetitive and showed that within 12 random transformation events about 20 to 40 fold differences in transgene expression were found. Representative examples of such findings are shown in Tables 32, 33, and 34). Based on these findings about 5 different events showing expression levels higher than the median were taken for further gene function validation (see Examples 6-9).

TABLE 32

| Results found for NUE 43 | Normalized Expression level | Expression level relative to lowest expression level found |
|---|---|---|
| FUE_43 Event 1 | 0.1503277 | 1 |
| FUE_43 Event 2 | 0.16169295 | 1.075603188 |
| FUE_43 Event 3 | 0.48948083 | 3.256092124 |
| FUE_43 Event 4 | 0.62021826 | 4.12577504 |
| FUE_43 Event 5 | 0.65818337 | 4.378324085 |
| FUE_43 Event 6 | 0.66609819 | 4.430974496 |
| FUE_43 Event 7 | 0.77390675 | 5.148131499 |
| FUE_43 Event 8 | 0.88588004 | 5.892992865 |
| FUE_43 Event 9 | 1.47644781 | 9.821528908 |
| FUE_43 Event 10 | 3.35576541 | 22.32300168 |

TABLE 33

| Results found for NUE 49 | Normalized Expression level | Expression level relative to lowest expression level found |
|---|---|---|
| FUE_49 Event 1 | 0.284411514 | 1 |
| FUE_49 Event 2 | 0.40568304 | 1.426394573 |
| FUE_49 Event 3 | 0.523973448 | 1.842307439 |
| FUE_49 Event 4 | 0.606977918 | 2.134153816 |

TABLE 33-continued

| Results found for NUE 49 | Normalized Expression level | Expression level relative to lowest expression level found |
| --- | --- | --- |
| FUE_49 Event 5 | 0.747036597 | 2.626604621 |
| FUE_49 Event 6 | 0.763272592 | 2.6836909 |
| FUE_49 Event 7 | 1.057302538 | 3.717509615 |
| FUE_49 Event 8 | 1.28937008 | 4.533466532 |
| FUE_49 Event 9 | 1.572327678 | 5.528354517 |
| FUE_49 Event 10 | 1.750374095 | 6.154371426 |
| FUE_49 Event 11 | 4.491236228 | 15.79133054 |
| FUE_49 Event 12 | 10.44746677 | 36.73362806 |

TABLE 34

| Results found for NUE 16 | Normalized Expression level | Expression level relative to lowest expression level found |
| --- | --- | --- |
| FUE_16 Event 1 | 0.143683 | 1 |
| FUE_16 Event 2 | 0.884513 | 6.156021 |
| FUE_16 Event 3 | 0.975626 | 6.790146 |
| FUE_16 Event 4 | 1.05558 | 7.346604 |
| FUE_16 Event 5 | 1.296067 | 9.020344 |
| FUE_16 Event 6 | 1.550371 | 10.79025 |
| FUE_16 Event 7 | 2.161574 | 15.04409 |
| FUE_16 Event 8 | 2.918563 | 20.31257 |
| FUE_16 Event 9 | 3.126949 | 21.76289 |
| FUE_16 Event 10 | 3.149679 | 21.92108 |
| FUE_16 Event 11 | 5.041681 | 35.089 |

Example 6

Improved Fertilizer Use Efficiency in Tissue Culture Assay

Materials and Methods

Assay 1: Nitrogen Use efficiency assay using plantlets—The assay was done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838).

Transgenic plants which were grown for 7-10 days in 0.5× MS [Murashige-Skoog] supplemented with a selection agent were transferred to two nitrogen-limiting conditions: MS media in which the combined nitrogen concentration ($NH_4NO_3$ and $KNO_3$) was 0.2 mM or 0.05 mM. Plants were allowed to grow for additional 30-40 days and then photographed, individually removed from the Agar (the shoot without the roots) and immediately weighed (fresh weight) for later statistical analysis. Constructs for which only T1 seeds were available were sown on selective media and at least 25 seedlings (each one representing an independent transformation event) were carefully transferred to the nitrogen-limiting media. For constructs for which T2 seeds were available, different transformation events were analyzed. Usually, 25 randomly selected plants from each event were transferred to the nitrogen-limiting media allowed to grow for 3-4 additional weeks and individually weighed at the end of that period. Transgenic plants were compared to control plants grown in parallel under the same conditions. Mock-transgenic plants expressing the uidA reporter gene (GUS) under the same promoter were used as control.

Statistical analyses—To identify genes conferring significantly improved nitrogen use efficiency (or tolerance to abiotic stresses or enlarged root architecture, see below) the results obtained from the transgenic plants were compared to those obtained from control plants. Plant area data, seed weight data and plant weight data were analyzed using one-way ANOVA. To identify outperforming genes and constructs, results from the independent transformation events tested were analyzed separately. In addition, genes and constructs were also analyzed taking into consideration the results obtained from all the independent transformation events tested the specific construct. For gene versus control analysis Student's t test or Tukey HSD test were applied, using significance of $p<0.05$. The JMP statistics software package was used (Version 5.2.1, SAS Institute Inc., Cary, N.C., USA). The same statistical analysis was used in Examples 6-9 which follow.

Results

Polynucleotide sequences of the present invention were assayed for a number of commercially desired traits.

FIG. 7 shows the ability FUE_504 or FUE_39 to improve NUE of transgenic plants expressing same. Clearly the transgenic plants grown on nitrogen are bigger and heavier than control plants expressing a control gene under the same promoter used to express the transgenes. To verify that the increase in the mass achieved by the transgenic plants is statistically significant, plants were individually weighed and the results of the entire population of events analyzed. As shown in Table 35 below transgenic plants expressing FUE_504 are significantly heavier than the control counterparts. The results demonstrate an improvement in NUE since the transgenic plants expressing FUE_504 are able to produce significantly more biomass than control plants starting from a similar nitrogen poor-media.

TABLE 35

| Nitrogen conc. | | Least Sq Mean weight (mg) | Std Error |
| --- | --- | --- | --- |
| 0.2 mM | Candidate 1 | 5.5185185* | 0.3626 |
| 0.2 mM | Control | 3.032 | 0.3769 |

*results are significantly different at $\alpha = 0.05$

Notably, whenever T1 plants were used to assay the effect of FUE_504; therefore each plant tested is a result of a different transformation event. Having this in mind it is clear that the effect found for T1 plants is a result of the transgene which is not associated with the transgene integration site. When T2 plants were assayed, the results were reproducible whereby in three independent transformation increased fresh weight was evident under limiting nitrogen conditions. Similar results were obtained for FUE_39 and FUE_52. As shown in Table 36 below three independent transgenic events contributed to the increase of the plantlet biomass under limiting nitrogen conditions. The results indicate that the expression of also FUE_39 and FUE_502 induces a significant improvement in nitrogen use efficiency.

TABLE 36

Least square means of fresh weight measured from ~25 plantlets grown for 30 days in 0.05 mM combined nitrogen concentration (NH$_4$NO$_3$ and KNO$_3$) (results analyzed using Student's t test)

| Level | | | | | | | | Least Sq Mean |
|---|---|---|---|---|---|---|---|---|
| TT105::FUE__52 Event 1 | A | | | | | | | 6.8000000 |
| TT105::FUE__39 Event 1 | A | B | | | | | | 6.5352941 |
| TT105::FUE__52 Event 2 | | B | C | | | | | 5.6272727 |
| TT105::FUE__39 Event 2 | | B | C | | | | | 5.6240000 |
| TT105::FUE__504 Event 1 | | B | C | | | | | 5.5956522 |
| TT105::FUE__39 Event 3 | | | C | D | | | | 5.4400000 |
| TT105::FUE__504 Event 2 | | | C | D | | | | 5.1666667 |
| TT105::FUE__52 Event 3 | | | C | D | E | | | 5.1473684 |
| TT105::FUE__504 Event 3 | | | C | D | E | | | 4.8882353 |
| TT105::GUS | | | | | | F G H I | | 3.6458333 |

Levels not connected by same letter are significantly different

Similar results were obtained when checking the same events at 0.2 mM combined nitrogen concentration. Four events transformed with TT105::NUE__39 produced statistically significant higher biomass when compared to control plants. Similar results were obtained with 3 events transformed with TT105::NUE__52 and 2 events transformed with TT105::NUE__504 as shown in Table 37.

TABLE 37

Least square means of fresh weight measured from ~25 plantlets grown for 30 days in 0.2 mM combined nitrogen concentration (NH$_4$NO$_3$ and KNO$_3$) (results analyzed using Student's t test)

| Level | | | | | | | | | Least Sq Mean |
|---|---|---|---|---|---|---|---|---|---|
| TT105::FUE__504 Event 1 | A | | | | | | | | 7.5250000 |
| TT105::FUE__52 Event 1 | A | B | | | | | | | 7.4571429 |
| TT105::FUE__39 Event 1 | A | B | | | | | | | 7.2000000 |
| TT105::FUE__39 Event 2 | A | B | C | | | | | | 6.7312500 |
| TT105::FUE__39 Event 3 | A | B | C | D | | | | | 6.6000000 |
| TT105::FUE__52 Event 2 | A | B | C | D | | | | | 6.5869565 |
| TT105::FUE__504 Event 2 | | B | C | D | E | | | | 6.3280000 |
| TT105::FUE__39 Event 4 | | | C | D | E | F | | | 5.8454545 |
| TT105::GUS (CONTROL) | | | | | | | G H I J | | 4.5720000 |

Levels not connected by same letter are significantly different

Positive results were also obtained in an assay performed using T1 seeds of transgenic plants overexpressing either FUE__8, FUE__14 or FUE__40 under a constitutive ubiquitous promoter (35S), as shown in Table 38 below.

TABLE 38

Least square means of fresh weight measured from ~25 plantlets grown for 27 days in 0.05 and 0.2 mM combined nitrogen concentration (NH$_4$NO$_3$ and KNO$_3$) (results analyzed using Student's t test MANOVA)

| Level | | | | | | Least Sq Mean |
|---|---|---|---|---|---|---|
| 35S::FUE__14 | B | | | | | 6.614423 |
| 35S::FUE__40 | B | C | | | | 5.552381 |
| 35S::FUE__8 | | C | | | | 5.252 |
| 35S::GUS Event 1 | | | D | E | F | 4.217095 |
| 35S::GUS Event 2 | | | | | F | 3.27 |

Levels not connected by same letter are significantly different

Similar results were obtained for different events of other constructs expressing FUE genes. An additional construct bearing the FUE_39 gene under the 35S promoter was checked using this assay as shown in the Table 39 below. In addition, two independent transformation events overexpressing the FUE_49 gene and additional events transformed with either FUE_4, FUE_3, or FUE_43 showed significantly higher biomass produced at both nitrogen limiting conditions tested as shown in table 39 below.

TABLE 39

Least square means of fresh weight measured from ~25 plantlets grown for 27 days in 0.05 and 0.2 mM combined nitrogen concentration ($NH_4NO_3$ and $KNO_3$) (results analyzed using Student's t test MANOVA)

| Level | | | | | | | | | | | | | | | | Least Sq Mean |
|---|---|---|---|---|---|---|---|---|---|---|---|---|---|---|---|---|
| 35S::FUE_43 event 1 | A | | | | | | | | | | | | | | | 5.572 |
| 35S::FUE_49 event 1 | A | B | | | | | | | | | | | | | | 5.025 |
| 35S::FUE_3 event 1 | A | B | | | | | | | | | | | | | | 4.924 |
| 5134.1 | A | B | C | | | | | | | | | | | | | 4.7 |
| 35S::FUE_49 event 2 | A | B | C | D | | | | | | | | | | | | 4.512 |
| 35S::FUE_4 event 1 | A | B | C | D | E | | | | | | | | | | | 4.383333 |
| wild type | | | | | | F | G | H | I | J | K | L | | | | | 3.123944 |
| 35S::GUS | | | | | | | | H | I | J | K | L | M | N | O | P | 2.702041 |

Levels not connected by same letter are significantly different

Taking into account the results obtained using this assay, several FUE genes have shown their ability to induce a significant improvement in nitrogen use efficiency. The genes that showed significant results are: FUE_504, FUE_39, FUE_52, FUE_502, as well as the following group of genes: FUE_14, FUE_8, FUE_40 and FUE_49, FUE_3, FUE_4 and FUE_43.

Assay 2: Nitrogen Use efficiency whole plant assay: Growth rate at limited nitrogen concentration—An additional assay designed to identify improved nitrogen use efficiency was developed. This assay follows the rosette area growth of plants grown in the greenhouse at limited nitrogen availability. Surface sterilized seeds were sown and plants grown at 25° C. under 23-hour light 1-hour dark daily cycles for 7-10 days in 0.5 x Murashige-Skoog medium in the presence of 2% sucrose. Then seedlings of similar size were carefully transferred to 100 ml pots filled with an inert growth medium support (a fine perlite mix). Seedlings were allowed to develop for a further week irrigated with a solution containing abundant supply of micro and macronutrients. Fertilizer excess was washed from the pots with at least two volumes of low-nitrate tap water. Then, plants were individually inspected and only healthy plants were chosen for growth rate analysis. The chosen plants were randomly distributed in several trays and used to assay for growth rate analysis under nitrogen limiting conditions. Constant nitrogen limiting conditions were achieved irrigating the plants with a solution containing 0.5 mM inorganic nitrogen (combined $KNO_3$ and $NH_4NO_3$ concentration), supplemented with 2 mM $CaCl_2$, 1.25 mM $KH_2PO_4$, 1.50 mM $MgSO_4$, 5 mM KCl, 0.01 mM $H_3BO_3$ and microelements. To follow plant growth, trays were photographed the day nitrogen limiting conditions were initiated and subsequently every 2-3 days for ~20 additional days. Rosette plant area was then determined from the digital pictures using the methodology described in FIG. 6. ImageJ software was used for quantifying the plant size from the digital pictures (Hypertext Transfer Protocol://rsb (dot) info (dot) nih (dot) gov/ij/) utilizing proprietary scripts designed to analyze the size of rosette area from individual plants as a function of time. Percentage of growth was calculated as the ratio of the plant rosette area divided by the initial plant area measured at day 1. To identify the transgenic plants within the experiment, the presence of the selection marker gene was checked using PCR. Leaf samples were taken from the plants, genomic DNA was extracted and served as template for a PCR using primers specific for the selection marker gene. Positive plants were tagged in order to exclude from the analysis the non-transgenic plants.

TABLE 40

Primers used for the PCR analysis:

| Primer name | Primer sequence/SEQ ID NO: |
|---|---|
| NPTII-F | CGAGAAAGTATCCATCATGGC/SEQ ID NO: 1512 |
| NPTII-R | ATGTCCTGATAGCGGTCCGC/SEQ ID NO: 1513 |

Results

In agreement with the results obtained in the previous assay in which FUE_39 showed improved NUE, the results presented herein show that FUE_39 significantly improved NUE in whole plants. As shown in Table 41 below, two independent transgenic events expressing FUE_39 were found to display enhanced NUE when compared to either wild type or transgenic plants expressing the GUS reporter gene under the same promoter used to express the FUE_39 transgene.

TABLE 41

FUE_39 shows the results of a growth rate assay under limiting nitrogen conditions. Two events showing enhanced NUE were shown.

| Level | | | | Least Sq Mean |
|---|---|---|---|---|
| 35S::FUE_39 Event 1 | A | | | 867.53380 |
| 35S::FUE_39 Event 2 | | B | | 685.52595 |
| Wild type | | | C D | 590.28343 |

Levels not connected by same letter are significantly different

In addition to FUE_39, also events overexpressing FUE_7 and FUE_41 were found to display enhanced growth rate under limiting nitrogen conditions. As shown in Table 42, FUE_7, FUE_41, FUE_50, FUE_16 expression under the 35S promoter are significantly better than control plants (wild type or expressing a reporter gene under 35S promoter).

TABLE 42

| Level | | | | | | | | | | Least Sq Mean |
|---|---|---|---|---|---|---|---|---|---|---|
| 5351.3 (35S::FUE_7) | A | | | | | | | | | 1184.9559 |
| 5375.1 (35S::FUE_41) | A | | | | | | | | | 1010.5752 |
| 5345.1 (35S::FUE_50) | A | B | | | | | | | | 956.9474 |
| 5361.2 (35S::FUE16) | | B | C | | | | | | | 824.0414 |
| 4545.7 (35S::GUS) | | | | D | E | F | G | H | I | 515.8663 |

Levels not connected by same letter are significantly different

Thus, the assay described here follows the ability of the plant to grow at limiting nitrogen conditions. Since the transgenic plants described above developed significantly faster than control plants it can be assumed that the outstanding events were able to assimilate the nitrogen available and to convert it to organic matter. As all the plants in the experiment were treated similarly, the results indicate that the outstanding events were able to utilize more efficiently the nitrogen available and therefore display enhanced nitrogen use efficiency.

Assay 3: Seed Yield assay at limited nitrogen availability—Maize plants absorb and store the majority of the nitrogen in leaves and stalk until flowering. Stored nutrients are then redistributed to the developing kernels. In the present assay plants were grown in limited nitrogen conditions as detailed in Assay 2 above for about 45 days and then grown until full maturity with tap water only. Plants are therefore forced to redistribute the stored nitrogen to the developing seeds. Plants that store more nitrogen are expected to have a better yield. Seeds were collected from individual plants and the yield was measured as seed weight. The yield of at least about 6 transgenic plants was usually measured for each event tested.

Results

In this assay transgenic plants overexpressing FUE_43 (under the 35S promoter) were found to have increased seed yield as shown in Table 43. The results of one of the events are presented below.

TABLE 43

| Level | | | | | | | | | Least Sq Mean |
|---|---|---|---|---|---|---|---|---|---|
| 5151.2 (35s::NUE43) | A | | | | | | | | 0.10411111 |
| 4542.4 (35S::GUS) | | B | C | D | E | F | G | H | 0.06647500 |

Levels not connected by same letter are significantly different

Taken as a whole the results shown here demonstrate that genes from this invention are capable of improving different aspects of nitrogen use efficiency as demonstrated by the results of the different assays disclosed here.

Example 7

Evaluating Transgenic Plant Growth Under Abiotic Stress Conditions

Tolerance to salinity or osmotic stress is aimed at identifying genes that confer better germination, seedling vigor or growth in high salt, drought or combination of same or other environmental stresses. Plants differ in their tolerance to salt stress, high osmoticum and drought during different stages of development. Therefore seed germination, plant development, and yield were evaluated independently under the different stress conditions.

A typical salinity tolerance test is produced taking plants at different developmental stages and irrigating them with increasing concentrations of NaCl (for example 50 mM, 100 mM, 200 mM, 400 mM) or constant concentration of NaCl. Transgenic plants are then compared to control plants in their external phenotypic appearance, degree of wilting, and overall success to reach maturity and yield progeny at concentrations inhibitory to control plants. Quantitative parameters of tolerance measured include, the average wet and dry weight, and the weight of the seeds yielded, the average seed size and the number of seeds produced per plant. Osmotic stress assays (including NaCl and mannitol assays) are conducted to determine if an osmotic stress tolerant phenotype is NaCl-specific or if it is a general osmotic stress related phenotype. Drought assays are performed for example halting irrigation during long period and measuring wilting rate, recovery and final yield. Plants tolerant to osmotic stress are in general more tolerant to drought, salinity and freezing conditions and therefore are highly valuable in terms of agronomic traits.

Materials and Methods

The method used to test the plants for improved abiotic stress tolerance includes the test of germination and seedling growth under adverse conditions such as high salinity and high osmoticum.

Germination assay under abiotic stresses—Germination tests compare the percentage of seeds from transgenic plants that could complete the germination process (radicle protrusion from the seed coat and complete opening of the cotyledons) to the percentage of seeds from control plants treated in the same manner. Evaluation of germination and seedling vigor was conducted for three weeks after planting. To measure germination and seedling growth, seeds from T2 plants were surface sterilized and individually sown on square agar plates containing for example, solidified basal media (50% Murashige-Skoog medium (MS)+vitamins supplemented with 0.8% plant agar) supplemented with high salinity (150 mM NaCl) or high osmoticum (210 mM mannitol). After sowing, plates were transferred for 2-3 days at 4° C. for stratification and then grown for three weeks.

To follow the germination and growth at adverse conditions plants were screened manually or automatically and plant size was determined. Various independent transformation events selected from Example 5 were analyzed from each construct. Plants expressing the genes from this invention were compared to control plants (wild type or mock-transformed plants) sown on the same plates under the same conditions.

Seedling growth under abiotic stress—A complementary experiment performed with seedlings follows the tolerance of the plants to adverse conditions. Surface sterilized seeds were sown in basal media [50% Murashige-Skoog medium (MS)+ vitamins supplemented with 0.8% plant agar as solidifying agent] in the presence of Kanamycin (for transgenic plants) or in its absence (for wild-type control plants). After sowing, plates were transferred for 2-3 days at 4° C. for stratification and then grown at 25° C. under 23-hour light 1-hour dark daily cycles for 7 to 10 days. At this time point, seedlings randomly chosen were carefully transferred to plates containing high salinity conditions (150 mM NaCl) or conditions resembling the high osmolarity found during drought (210 mM mannitol). Plant growth was followed as a function of time using digital imaging. To follow the plant growth at adverse conditions plants were photographed the day they were transferred to the stress conditions (Day 1). Pictures were subsequently taken every few days after transferring the plants to the stress condition and up to 12 days after the transfer. Rosette plant area was then determined from the digital pictures. ImageJ software was used for quantifying the plant size from the digital pictures (Hypertext Transfer Protocol://rsb (dot) info (dot) nih (dot) gov/ij/). Proprietary scripts were designed to analyze the size of individual plants rosette areas as a function of time. FIG. 6 shows the methodology used for image area quantification. Five to ten independent transformation events were analyzed from each construct and at least 6 randomly selected plants from each event were analyzed in each stress experiment. Plants expressing the genes from this invention were compared either to control plants sown on the same stress inducing plates (internal controls) or to the average measurement of all the control plants used in the same experiment (all controls).

Results

Salinity and osmoticum tolerance were assayed by following plant growth during stress, as evidenced by plant green area. Several genes and constructs were checked using the procedure described above and significant tolerance results were found. For instance, transgenic plants overexpressing the following genes have shown statistically significant improved tolerance to high salinity stress: FUE_7, FUE_10, FUE_14, FUE_16, FUE_33, FUE_37, FUE_39, FUE_40, FUE_41, FUE_47, FUE_50, FUE_502, FUE_503 and FUE_504.

In addition, the following genes provided statistically significant results in coffering abiotic stress tolerance to the transgenic plants overexpressing same when exposed to high osmolarity stress: FUE_3, FUE_9, FUE_10, FUE_13, FUE_37, FUE_39, FUE_40, FUE_41, FUE_43, FUE_49, FUE_502, FUE_503 and FUE_504.

In addition, transgenic plants expressing FUE_43 and FUE_503 were found to have increased ability to germinate under high osmoticum conditions (Data not shown).

Furthermore, transgenic plants expressing the following genes have shown significantly increased abiotic stress tolerance to either salinity or high osmolarity: FUE_10, FUE_37, FUE_39, FUE_40, FUE_41, FUE_502 and FUE_504.

It should be noted that the significance of the results is in general supported by several transgenic events expressing the above genes and in some cases also under different promoters. Table 44a-b summarize these findings. Results are expressed as the growth area percentage related to the size of the plant when transferred to stress conditions (i.e., Day 1).

TABLE 44a list of genes showing improved seedling growth under salinity stress

| Gene | Promoter | Event/Gene | | | Least Sq Mean |
|---|---|---|---|---|---|
| FUE_502 | 35S | 5125.3 | A | | 402.61787 |
| | | CONTROL | | B | 270.40066 |
| FUE_503 | | 5184.3 | A | | 314.80237 |
| | | CONTROL | | B | 163.06265 |
| FUE_504 | 35S | 5147.5 | A | | 335.25831 |
| | | CONTROL Level | | B | 258.27089 |
| | TT105 | 5432.9 | A | | 525.38863 |
| | | 5433.5 | A | | 382.86771 |
| | | 5433.4 | A | | 346.97902 |
| | | 5433.6 | A | | 342.96170 |
| | | CONTROL | | B | 257.88942 |
| FUE_7 | 35S | 5351.8 | A | | 508.52644 |
| | | CONTROL | | B | 410.02970 |
| FUE_10 | 35S | 5331.1 | A | | 404.86015 |
| | | CONTROL | | B | 320.63800 |
| | | Experiment performed on T1 plants | | | |
| FUE_14 | RootP | RootP::FUE14 | A | | 239.97813 |
| | | 35S::GUS | B | | 193.74654 |
| | 35S | 5451.3 | A | | 170.50102 |
| | | 5454.1 | A | | 154.77155 |
| | | 5454.4 | A | B | 151.54574 |
| | | CONTROL | | C | 130.92706 |
| | | Experiment performed on T1 plants | | | |
| FUE_16 | RootP | RootP::FUE16 | A | | 184.69992 |
| | | 35S::GUS | B | | 146.24402 |
| | | Experiment performed on T1 plants | | | |
| FUE_33 | RootP | RootP::FUE33 | A | | 237.73455 |
| | | 35S::GUS | B | | 202.99142 |
| | | Experiment performed on T1 plants | | | |
| FUE_37 | RootP | RootP::FUE37 | A | | 228.14620 |
| | | 35S::GUS | B | | 195.15386 |
| FUE_39 | 35S | 5131.1 | A | | 272.46189 |
| | | CONTROL | B | C | 195.66170 |
| | | Experiment performed on T1 plants | | | |
| FUE_40 | 35S | 35S::FUE_40 | A | | 261.52868 |
| | | 35S::GUS | B | | 160.55573 |
| FUE_41 | 35S | 5373.1 | A | | 452.27789 |
| | | CONTROL | B | C | 373.83060 |
| | | Experiment performed on T1 plants | | | |
| FUE_47 | 35S | FUE47 | A | | 202.37548 |
| | | 35S::GUS | B | | 142.22673 |
| FUE_50 | | 5343.1 | A | | 452.75078 |
| | | CONTROL | | B | 376.63355 |

TABLE 44b list of genes showing improved seedling growth under osmoticum stress

| Gene | Promoter | Event/Gene | | | Least Sq Mean |
|---|---|---|---|---|---|
| FUE_502 | 35S | 5125.9 | A | | |
| | | 5125.10 | | B | 156.16627 |

TABLE 44b-continued list of genes showing improved seedling growth under osmoticum stress

| Gene | Promoter | Event/Gene | | Osmoticum Seedling Growth Assay | | Least Sq Mean |
|---|---|---|---|---|---|---|
| | | 5125.1 | | B | | 145.40683 |
| | | CONTROL | | | C | 92.51323 |
| | | Experiment performed on T1 plants | | | | |
| | TT105 | TT105::FUE502 | A | | | 145.94616 |
| | | TT105:GUS | | B | | 129.39693 |
| FUE_503 | | 5182.3 | A | | | 163.93440 |
| | | 5181.2 | A | | | 151.83208 |
| | | CONTROL | | B | | 126.70438 |
| | | Experiment performed on T1 plants | | | | |
| FUE_504 | TT105 | TT105::FUE504 | A | | | 172.68759 |
| | | TT105:GUS | | B | | 145.85106 |
| FUE_3 | 35S | 5213.1 | A | | | 309.25610 |
| | | CONTROL | | B | C | 244.05079 |
| FUE_9 | RootP | RootP::FUE9 | A | | | 213.03081 |
| | | 35S::GUS | | B | | 175.62303 |
| FUE_10 | 35S | 5331.1 | A | | | 438.55622 |
| | | CONTROL | | B | | 202.58577 |
| FUE_13 | 35S | 5235.2, 7 | A | | | 312.47256 |
| | | CONTROL, 7 | | B | C | 233.04378 |
| | | Experiment performed on T1 plants | | | | |
| | RootP | RootP::FUE13 | A | | | 173.97881 |
| | | 35S::GUS | | B | | 134.41030 |
| | | Experiment performed on T1 plants | | | | |
| FUE_37 | RootP | RootP::FUE37 | A | | | 205.43584 |
| | | 35S::GUS | | B | | 168.99783 |
| FUE_39 | 35S | 5131.1 | A | | | 261.25201 |
| | | CONTROL | | B | | 177.03349 |
| | | Experiment performed on T1 plants | | | | |
| FUE_40 | 35S | 35S::FUE_40 | A | | | 142.16470 |
| | | 35S::GUS | | B | | 125.81481 |
| FUE_41 | 35S | 5373.2 | A | | | 306.74015 |
| | | 5371.4 | | B | | 231.50773 |
| | | CONTROL | | | C | 196.22318 |
| FUE_49 | 35S | 5243.3, 7 days | A | | | 382.37255 |
| | | CONTROL, 7 days | | B | C | 270.81987 |

Example 8

Evaluating Changes in Root Architecture in Transgenic Plants

Many key traits in modern agriculture can be explained by changes in the root architecture. Root size and depth correlates with drought tolerance and fertilizer use efficiency. Deeper root systems can access water in stored in deeper soil layers. Similarly, a highly branched root system provides better coverage of the soil and therefore can effectively absorb all macro and micronutrients available resulting in enhanced fertilizer use efficiency. To test whether the transgenic plants produce a different root structure, plants were grown in agar plates placed vertically. Plates were photographed every few days and the maximal length and total area covered by the plant roots were assessed from the digital pictures. From every construct created, several independent transformation events were checked in replicates. To assess significant differences between root features, one ANOVA using Students t-test was employed in order to identify the events showing outstanding root features and to provide a statistical score to the findings (statistical assays are described above).

Results

When analyzing different aspects of root architecture such as total root area covered and maximal depth (length) achieved by the root system, it was found that transgenic plants expressing FUE genes have remarkable features. For instance, transgenic plants overexpressing FUE_10 and FUE_49 were found to have a higher root area coverage based on measurements done 21 days following germination (see Table 45).

TABLE 45

Root Area (in $cm^2$) measured at day 21

| Level | | | | Least Sq Mean |
|---|---|---|---|---|
| 21 days 35S::NUE10 | A | | | 1.3313852 |
| 21 days 35S::NUE49 | A | | | 1.3253389 |
| 21 days 35S::GUS | | B | C | 1.1289837 |

Levels not connected by same letter are significantly different

Similarly, plants overexpressing FUE_16 and FUE_7 original were found to produce the longest root architecture (see Table 46 below). FUE_16 was found to produce the fastest penetrating root system from all the constructs tested at all days tested (7, 14 and 21 days after germination).

In practice, these findings suggest that plants overexpressing FUE_16 and FUE_7_Original reach deeper soil layers compared to other plants at the same period of time. These plants are expected to maximally retrieve fertilizers and water from the soil and withstand better longer periods of drought.

TABLE 46

Statistical analysis of root length (in cm) measured at day 21

| Level | | | | | Least Sq Mean |
|---|---|---|---|---|---|
| 21 days 35S::FUE_7_Original | A | | | | 6.5156396 |
| 21 days 35S::FUE_16 | A | B | | | 6.1808293 |
| 21 days 35S::GUS | | | C | D | 5.5097884 |

Levels not connected by same letter are significantly different

The enhanced root architecture allows transgenic plants expressing FUE genes to absorb more successfully the nutrients (fertilizers) and water available in the soil. Increased uptake and nutrient recovery is a key feature for improved fertilizer use efficiency and abiotic stress tolerance. Deeper root systems allow plants to access water available in deeper soil layers enhancing the tolerance to extended drought periods and therefore ensuring high yields also under harsh conditions.

Example 9

FUE 40 Expressing Plants are Characterized by a Plant Architecture for Maximal Seed Production The presence of multiple seed producing organs (pods, fruits, etc) and strong flowering stems is a key feature to produce high seed yields. While reducing the present invention to practice, the present inventors have surprisingly found that transgenic plants expressing FUE_40 under a constitutive promoter have improved reproductive organ architecture. The flowering stems were unusually stiff and strong and carry a large number of siliques (see FIG. 9 showing different independent transformation events). The results were confirmed by a triple blind assay identifying plants having more siliques per plant, probably due to faster growth of lateral inflorescence shoots. Interestingly, all the plants were different transformation events bearing the same construct, NUE40 gene under 35S promoter (see FIG. 9). This alteration in plant development characteristics can be used to significantly increase seed yield of a plant.

Example 10

CT-9 (SEQ ID NO: 1340, 1341) and CT-71 (SEQ ID NO: 1342, 1343) Confer Drought Tolerance and Increased Yield of Transgenic Tomato While further reducing the present invention to practice the present inventors have surprisingly uncovered that CT_9 (SEQ ID NOs. 1340, 1341 previously disclosed in PCT Application No. WO2005/121364) and CT_71 (SEQ ID NOs. 1342 and 1343, previously disclosed in PCT Application No. WO2005/121364) confer drought resistance and increased yields in transgenic plants expressing same. CT_9 and CT_71 were disclosed in PCT Application No. WO2005/121364 to Evogene Ltd. and in U.S. Pat. No. 5,597, 718 (CT 71).

Materials and Experimental Procedures

Drought assay—The drought assay described herein was effected in field conditions mimicking drought stress by controlling the amount of water supplied and the drought intervals. The assay, one source dripping irrigation system (OSDI), is similar to the farmer field since it creates water deficiency in a relatively uniform manner and enables to measure the effect of drought on small size populations of plants.

Thus, the present irrigation method may be effected as follows:
(a) placing on or in a soil a dripping irrigation system so as to obtain irrigation holes distributed 20-40 cm (e.g., 30 cm) from one another in the X and Y directions; and
(b) continuously irrigating through each of said irrigation holes at an irrigation rate of 0.5-2 liter water per hour.

One configuration of an irrigation system (10) for mimicking drought conditions which comprises the following components and illustrated in FIG. 10 may be used in accordance with the teachings of the present invention:
(i) a dripping irrigation system having a plurality of irrigation holes (12) distributed 20-40 cm from one another in the X and Y directions; and
(ii) a water supply and control system (14) for continuously irrigating through each of said irrigation holes 0.5-2 liter water per hour.

Preferred drippers used are pressure-compensated thick-walled dripper line with anti-siphon and anti-drain systems (UniRam™ CNL #16010, Flow Rate 1.6 l/h from Netafim Israel). Anti-siphon system prevents dirt backflow into the dripper line while anti-drain (CNL) system eliminates drainage and refill effect, and improves efficiency in pulse irrigation.

The OSDI method was developed on the basis of the line source sprinklers irrigation system (Hanks et al. 1976 Soil Sci. Soc Am. J. 40 p. 426-429) with significant modifications. Instead of sprinklers irrigation a dripping irrigation was used. In order to create a uniform and deep wet layer (at least 60 cm depth) and not the onion shape layer that is typically created by dripping irrigation a low pressure compensating dripping irrigation system was used that allow providing small amount of water in a relatively long period of time.

The experiment was created in light soil during summer 2006 (from July to September), in an open field nethouse near Rehovot, Israel.

The water capacity of the soil was measured using the standard procedures by sampling soil from the following three depths: 0 to 20 cm, 20 to 40 cm and 40 to 60 cm. The water content in these soil layers was measured routinely every week. The soil contained 5% hygroscopic water while the maximum water capacity of the soil was 20%. All fertilizers were applied into the soil prior to sowing. The amount of both phosphorus and potassium was calculated to be sufficient for all season. Nitrogen was applied as recommended, equally to all the treatments through the irrigation system.

Each row, 193 cm wide, contained three dripping irrigation lines creating coverage of nine drippers per 1 sq. m. The water control was done separately for each treatment. The soil was dried completely before the beginning of the experiment.

Sowing was done in a nursery conditions under regular water irrigation. The seedlings were transplanted after four weeks into wet soil. The water amount that was used to uniformly irrigate before transplanting reached the maximum water capacity (20% w/w) at 60 cm depth however without creation of water overload. Each plant was transplanted near a dripper, 30 cm distance between plants with a total density of 2600 plants per 1000 sq. m, according to commercial growth protocol. The experiment was structured in four blocks containing three rows irrigated with different water levels and intervals (WLI-0, WLI-1, WLI-2). The different water regimes started only four weeks following transplanting when plants reached the flowering stage. The amount of water supplied every week during the assay was calculated at every beginning of the week following the recommendations of standard growing protocols.

WLI-0 treatment received the recommended total weekly irrigation volume, but divided in three irrigations. The two other treatments (WLI-1 and WLI-2) represent two different level of water deficiency. WLI-1 was also irrigated three times a week, but the amount of water supplied was half of the irrigation supplied to WLI-0. At the end of every week, WLI-1 plants received the amount of water required to reach maximum soil water capacity. WLI-2 was not irrigated during the week but rather at the beginning of every week. Water was supplied to achieve the maximum water capacity. The water stress experiment lasted throughout the flowering period (23 days) corresponding to 4 cycles of the stresses described above. Afterwards, all the treatments received the recommended amount of water.

The calculation of the water amount was equal to the difference between water content in dry soil and soil with maximum water capacity. At the end of each stress cycle the water amount was compared between treatments according to actual water content in the soil (Table 47)

TABLE 47

Water content (%) in the soil at the end of the $4^{th}$ stress cycle (23 days)

| Soil depth (cm) | Water content in the soil (% w/w) Treatment | | |
|---|---|---|---|
| | Control - WLI-0 | WLI-1 | WLI-2 |
| 0-20 | 17 | 14 | 10 |
| 20-40 | 16 | 12 | 12 |
| 40-60 | 15 | 12 | 11 |

Of note, during the stress period treatments WLI-1 and WLI-2 received in total 75% less water compared to control (WLI-0).

Gene cloning and expression—Bioinformatic identification, cloning and phenotypic evaluation of CT-9 and CT-71 was described in Patent No: WO2005/121364.

CT-9 or CT-71 ligated to binary constructs, comprising the 35S promoter were transformed into tomato plants via *Agrobacterium tumefacience* transformation.

60 μL of *Agrobacterium tumefaciens* LB4404 competent cells (about $10^9$ cells/mL) were transformed with 20 ng of binary plasmid via electroporation, using a MicroPulser electroporator (Biorad), 0.2 cm cuvettes (Biorad) and EC-2 electroporation program (Biorad).

*Agrobacterium* cells were grown on 0.8 mL LB liquid medium at 28° C. for 3 hrs and 0.2 mL of the cell suspension were plated on LB-agar plates supplemented with the antibiotics streptomycin 300 mg/L (for *Agrobacterium* strain LB4404) and kanamycin 50 mg/L (Sigma). Plates were then incubated at 28° C. for 48 hrs. *Agrobacterium* colonies were grown and PCR amplification was performed on *Agrobacterium* cells, using primers which were designed to span the inserted sequence in the binary vector.

PCR products were separated on 1.5% agarose gels and product sizes were determined by comparing to DNA ladder (MBI Fermentas). PCR products with the predicted size were sequenced using the primers which were used for the PCR amplification. Sequencing of the inserted sequence was performed to verify that the right clones were introduced into the *Agrobacterium* cells.

DNA sequencing was effected using ABI 377 sequencer (Amersham Biosciences Inc.).

Transformation of Micro-Tom tomato plants with CT_9 or CT-71—Tomato (*Lycopersicon esculentum*, var MicroTom) transformation and cultivation of transgenic plants was effected according to Curtis et al. 1995 Methods Mol. Biol. 1995; 44:59-70., and Meissner et. al. 2000. Plant J. 2000 May; 22(3):265-74. Following transformation, T1 MicroTom tomato plants were grown in a mix contained in 1000 ml pots, until fruit set and T2 seeds harvesting. Transgenic micro-tom tomato plants over expressing the CT-9 or CT-71 genes under the regulation of the 35S promoter were cross-pollinated with M82 commercial variety plants. Taking randomly four plants originated from four different insertion events representing the position effect. The F1 hybrids which include the transgene were used for further evaluation. As a negative control, non-transgenic plants that segregated from the same transgenic populations were used. To distinguish between transgenic and non transgenic plants a PCR screening was effected using primers of the NPTII gene as described in example 6.

Results

At the fruit ripening stage of about 90% red fruits, plants were evaluated and fruits were harvested. Plant performance was evaluated by measuring mass of the canopies, root length and mass. The yield was measured by taking green and red full size fruits for each plant. The results were analyzed using one side Anova test and summarized in Table 48, below.

TABLE 48

Total fruit yield of the plant lines grown under severe water stress (WLI-2) expressing CT-9 gene compared to control plants.

| Name of the line | Mean of total full size fruit weight per plant (g) - gene construct | Mean of total full size fruit weight per plant (g) - best performing event |
|---|---|---|
| Control - non transgenic plants | 656 c | 656 c |
| CT-71 | 692 b c | 707 b c |
| CT-9 | 782 a | 840 a | a, b, c - Levels not connected by same letter are statistically significantly different at P < 0.05

The transgenic lines overexpressing CT-9 showed significantly higher fruit yield under severe water deficiency conditions (WLI-2) compared to control plants.

The improvement in yield was observed also under regular water irrigation both for lines expressing CT-9 and CT-71 (see Table 49, below).

TABLE 49

Total fruit yield of the lines over expressing CT-9 compared to control plants grown under favorable water irrigation (WLI-0)

| Name of the line | Mean of total full size fruit weight per plant (g) - gene construct | Mean of total full size fruit weight per plant (g) - best performing event |
|---|---|---|
| Negative control - non transgenic plants | 820 b | 820 b |
| CT-71 | 1010 a | 1046 a |
| CT-9 | 993 a | 997 a b | a, b, c - Levels not connected by same letter are statistically significantly different at P < 0.05

Example 11

Plants Overexpressing FUE__34_Evo are Characterized by Enhanced Lateral Branching Control of lateral buds activation can have an important role in modern agriculture and breeding of flowers and ornaments. In the case of modern maize breeding, breeders worked for many years towards the reduction of tillers (lateral branches) in order to create single husk plants that reach maturation concurrently. On the other hand, control of tillering in rice breeding has also importance since multiple tillers will allow the production of several panicles on the same plant while overtillering has deleterious effects on the plant. Similarly, lateral branching is important for ornamentals, for example to produce multiple flowers from the same stem, or to produce single large flowers from each stem.

As shown in FIG. 8 plants expressing exogenous FUE__34_Evo are characterized by multiple branching of the shoot. Expression of FUE__34 Evo (SED ID No: 54) under a constitutive ubiquitous promoter caused unusually active lateral branching phenotype. All the transgenic events obtained with these constructs display this particular branching phenotype at every node. This phenotype can be a result of the loss of the plant apical dominance or more likely to the continuous expression of Evo__34_Evo under an ubiquitous constitutive promoter. Evo__34 is a MADS box transcription factor that contains in addition putative phosphorylation sites for cAMP- and cGMP-dependent protein kinase, Casein kinase II and Protein kinase C. Expression under a root preferred promoter such as RootP caused the creation of a compact highly branched root phenotype. FUE__34_Evo can be therefore used for example to engineer plants with controlled branching adding a constitutive or inducible promoter active at certain anatomical parts of the plant and/or at certain developing stages. Similarly the gene can be silenced and in this way tillering or lateral branching will be highly likely avoided. Another potential use for this gene is for MAS (Marker assisted breeding).

Example 12

Homologous and Orthologous Sequences

Table 50 lists a summary of orthologous and homologous sequences of the polynucleotide sequences and polypeptide sequences of the invention identified using BLAST (TBLASTX program) having at least 85% similarity on at least 85% of the entire protein length.

TABLE 50

| Gene | SEQ ID NO: Polynucleotide/polypeptide | organism | Species | coverage | percent_identity |
|---|---|---|---|---|---|
| FUE_1 | 219/768 | maize | Zea mays | 100 | 100 |
| FUE_1 | 220/769 | rice | Oryza sativa | 89.47 | 77.44 |
| FUE_1 | 221/770 | sorghum | Sorghum bicolor | 87.22 | 81.95 |
| FUE_1 | 222/771 | sugarcane | Saccharum officinarum | 88.72 | 84.96 |
| FUE_1 | 223/772 | wheat | Triticum spp. | 96.99 | 96.24 |
| FUE_1 | 224/773 | wheat | Triticum spp. | 100 | 98.5 |
| FUE_2 | 225/774 | maize | Zea mays | 98.48 | 95.45 |
| FUE_2 | 226/775 | maize | Zea mays | 100 | 100 |
| FUE_2 | 227/776 | maize | Zea mays | 100 | 100 |
| FUE_2 | 228/777 | sorghum | Sorghum bicolor | 89.39 | 84.85 |
| FUE_2 | 229/778 | sorghum | Sorghum bicolor | 89.39 | 84.85 |
| FUE_2 | 230/779 | sorghum | Sorghum bicolor | 89.39 | 84.85 |
| FUE_2 | 231/780 | wheat | Triticum spp. | 100 | 100 |
| FUE_3 | 232/781 | maize | Zea mays | 92.08 | 88.12 |
| FUE_3 | 233/782 | maize | Zea mays | 100 | 99.01 |
| FUE_3 | 234/783 | maize | Zea mays | 100 | 100 |
| FUE_3 | 235/784 | maize | Zea mays | 100 | 100 |
| FUE_3 | 236/785 | sorghum | Sorghum bicolor | 88.12 | 85.15 |
| FUE_3 | 237/786 | sorghum | Sorghum bicolor | 88.12 | 85.15 |
| FUE_3 | 238/787 | sugarcane | Saccharum officinarum | 96.04 | 91.09 |
| FUE_3 | 239/788 | wheat | Triticum spp. | 100 | 99.01 |
| FUE_4 | 240/789 | maize | Zea mays | 97.63 | 96.45 |
| FUE_5 | 241/790 | barley | Hordeum vulgare | 89.68 | 76.98 |
| FUE_5 | 242/791 | barley | Hordeum vulgare | 89.68 | 76.98 |
| FUE_5 | 243/792 | cotton | Gossypium ssp. | 85.71 | 72.22 |
| FUE_5 | 244/793 | cotton | Gossypium ssp. | 85.71 | 72.22 |
| FUE_5 | 245/794 | maize | Zea mays | 91.27 | 77.78 |
| FUE_5 | 246/795 | maize | Zea mays | 88.89 | 80.16 |
| FUE_5 | 247/796 | maize | Zea mays | 88.89 | 80.16 |
| FUE_5 | 248/797 | maize | Zea mays | 98.41 | 95.24 |
| FUE_5 | 249/798 | maize | Zea mays | 99.21 | 99.21 |
| FUE_5 | 250/799 | maize | Zea mays | 100 | 100 |
| FUE_5 | 251/800 | rice | Oryza sativa | 86.51 | 80.16 |
| FUE_5 | 252/801 | rice | Oryza sativa | 86.51 | 80.16 |
| FUE_5 | 253/802 | rice | Oryza sativa | 91.27 | 83.33 |
| FUE_5 | 254/803 | rice | Oryza sativa | 92.06 | 83.33 |
| FUE_5 | 255/804 | sesame | Sesamum indicum | 85.71 | 73.81 |
| FUE_5 | 256/805 | sesame | Sesamum indicum | 85.71 | 74.6 |
| FUE_5 | 257/806 | sorghum | Sorghum bicolor | 88.1 | 78.57 |
| FUE_5 | 258/807 | sorghum | Sorghum bicolor | 97.62 | 92.06 |
| FUE_5 | 259/808 | sorghum | Sorghum bicolor | 97.62 | 92.06 |
| FUE_5 | 260/809 | sugarcane | Saccharum officinarum | 88.89 | 80.95 |
| FUE_5 | 261/810 | sugarcane | Saccharum officinarum | 97.62 | 93.65 |
| FUE_5 | 262/811 | tobacco | Nicotiana spp. | 85.71 | 70.63 |
| FUE_5 | 263/812 | tobacco | Nicotiana spp. | 85.71 | 70.63 |
| FUE_5 | 264/813 | tobacco | Nicotiana spp. | 85.71 | 70.63 |
| FUE_5 | 265/814 | wheat | Triticum spp. | 90.48 | 76.98 |
| FUE_5 | 266/815 | wheat | Triticum spp. | 91.27 | 76.98 |
| FUE_5 | 267/816 | wheat | Triticum spp. | 90.48 | 76.98 |
| FUE_5 | 268/817 | wheat | Triticum spp. | 91.27 | 77.78 |
| FUE_5 | 269/818 | wheat | Triticum spp. | 85.71 | 79.37 |
| FUE_40 | 270/819 | barley | Hordeum vulgare | 85.89 | 77.91 |
| FUE_40 | 271/820 | maize | Zea mays | 85.89 | 80.37 |
| FUE_40 | 272/821 | maize | Zea mays | 85.89 | 80.37 |
| FUE_40 | 273/822 | maize | Zea mays | 100 | 100 |
| FUE_40 | 274/823 | rice | Oryza sativa | 85.89 | 71.17 |
| FUE_40 | 275/824 | sorghum | Sorghum bicolor | 86.5 | 73.01 |
| FUE_40 | 276/825 | sorghum | Sorghum bicolor | 86.5 | 73.01 |
| FUE_40 | 277/826 | sorghum | Sorghum bicolor | 90.8 | 86.5 |
| FUE_40 | 278/827 | sorghum | Sorghum bicolor | 91.41 | 87.73 |
| FUE_40 | 279/828 | sorghum | Sorghum bicolor | 91.41 | 87.73 |
| FUE_7 | 280/829 | maize | Zea mays | 98.63 | 98.63 |
| FUE_7 | 281/830 | sorghum | Sorghum bicolor | 87.67 | 86.3 |
| FUE_9 | 282/831 | maize | Zea mays | 100 | 100 |
| FUE_9 | 283/832 | sorghum | Sorghum bicolor | 94.35 | 90.4 |
| FUE_10 | 284/833 | maize | Zea mays | 99.14 | 99.14 |
| FUE_11 | 285/834 | maize | Zea mays | 96.83 | 94.44 |
| FUE_11 | 286/835 | maize | Zea mays | 95.24 | 94.44 |
| FUE_11 | 287/836 | maize | Zea mays | 97.62 | 96.03 |
| FUE_11 | 288/837 | maize | Zea mays | 97.62 | 96.03 |
| FUE_11 | 289/838 | maize | Zea mays | 97.62 | 96.03 |
| FUE_11 | 290/839 | maize | Zea mays | 98.41 | 96.83 |
| FUE_11 | 291/840 | maize | Zea mays | 96.83 | 96.83 |
| FUE_11 | 292/841 | maize | Zea mays | 97.62 | 97.62 |
| FUE_11 | 293/842 | maize | Zea mays | 99.21 | 99.21 |
| FUE_11 | 294/843 | sorghum | Sorghum bicolor | 91.27 | 85.71 |
| FUE_11 | 295/844 | sorghum | Sorghum bicolor | 91.27 | 85.71 |

TABLE 50-continued

| Gene | SEQ ID NO: Polynucleotide/polypeptide | organism | Species | coverage | percent_identity |
|---|---|---|---|---|---|
| FUE_11 | 296/845 | sugarcane | *Saccharum officinarum* | 88.1 | 84.13 |
| FUE_11 | 297/846 | wheat | *Triticum* spp. | 96.03 | 95.24 |
| FUE_12 | 298/847 | maize | *Zea mays* | 99.2 | 98.93 |
| FUE_12 | 299/848 | maize | *Zea mays* | 99.47 | 99.2 |
| FUE_12 | 300/849 | maize | *Zea mays* | 99.73 | 99.2 |
| FUE_12 | 301/850 | rice | *Oryza sativa* | 90.67 | 80.53 |
| FUE_13 | 302/851 | maize | *Zea mays* | 100 | 100 |
| FUE_14 | 303/852 | barley | *Hordeum vulgare* | 85.33 | 77.33 |
| FUE_14 | 304/853 | barley | *Hordeum vulgare* | 85.78 | 79.56 |
| FUE_14 | 305/854 | barley | *Hordeum vulgare* | 87.11 | 80.44 |
| FUE_14 | 306/855 | barley | *Hordeum vulgare* | 88.44 | 81.78 |
| FUE_14 | 307/856 | barley | *Hordeum vulgare* | 88.44 | 81.78 |
| FUE_14 | 308/857 | maize | *Zea mays* | 85.78 | 75.11 |
| FUE_14 | 309/858 | maize | *Zea mays* | 85.78 | 75.11 |
| FUE_14 | 310/859 | maize | *Zea mays* | 86.22 | 76 |
| FUE_14 | 311/860 | maize | *Zea mays* | 86.22 | 76 |
| FUE_14 | 312/861 | maize | *Zea mays* | 87.11 | 78.22 |
| FUE_14 | 313/862 | maize | *Zea mays* | 85.33 | 81.33 |
| FUE_14 | 314/863 | maize | *Zea mays* | 92.44 | 88.44 |
| FUE_14 | 315/864 | maize | *Zea mays* | 92.44 | 88.89 |
| FUE_14 | 316/865 | maize | *Zea mays* | 92.89 | 88.89 |
| FUE_14 | 317/866 | maize | *Zea mays* | 92.89 | 89.33 |
| FUE_14 | 318/867 | maize | *Zea mays* | 93.33 | 89.33 |
| FUE_14 | 319/868 | maize | *Zea mays* | 93.33 | 89.33 |
| FUE_14 | 320/869 | maize | *Zea mays* | 94.67 | 90.22 |
| FUE_14 | 321/870 | maize | *Zea mays* | 100 | 100 |
| FUE_14 | 322/871 | maize | *Zea mays* | 100 | 100 |
| FUE_14 | 323/872 | rice | *Oryza sativa* | 85.33 | 73.33 |
| FUE_14 | 324/873 | rice | *Oryza sativa* | 85.33 | 73.33 |
| FUE_14 | 325/874 | rice | *Oryza sativa* | 85.33 | 74.22 |
| FUE_14 | 326/875 | rice | *Oryza sativa* | 85.33 | 74.22 |
| FUE_14 | 327/876 | rice | *Oryza sativa* | 88 | 77.78 |
| FUE_14 | 328/877 | rice | *Oryza sativa* | 88 | 77.78 |
| FUE_14 | 329/878 | rice | *Oryza sativa* | 85.78 | 79.56 |
| FUE_14 | 330/879 | rice | *Oryza sativa* | 85.78 | 79.56 |
| FUE_14 | 331/880 | rice | *Oryza sativa* | 86.67 | 80.89 |
| FUE_14 | 332/881 | rice | *Oryza sativa* | 86.67 | 81.33 |
| FUE_14 | 333/882 | rice | *Oryza sativa* | 86.67 | 81.33 |
| FUE_14 | 334/883 | rice | *Oryza sativa* | 88 | 81.78 |
| FUE_14 | 335/884 | rice | *Oryza sativa* | 87.56 | 81.78 |
| FUE_14 | 336/885 | rice | *Oryza sativa* | 88 | 81.78 |
| FUE_14 | 337/886 | rice | *Oryza sativa* | 87.56 | 81.78 |
| FUE_14 | 338/887 | rice | *Oryza sativa* | 87.56 | 82.22 |
| FUE_14 | 339/888 | rice | *Oryza sativa* | 87.56 | 82.22 |
| FUE_14 | 340/889 | rice | *Oryza sativa* | 87.56 | 82.67 |
| FUE_14 | 341/890 | rice | *Oryza sativa* | 87.56 | 82.67 |
| FUE_14 | 342/891 | rice | *Oryza sativa* | 88 | 83.11 |
| FUE_14 | 343/892 | rice | *Oryza sativa* | 88 | 83.11 |
| FUE_14 | 344/893 | sorghum | *Sorghum bicolor* | 86.22 | 76.44 |
| FUE_14 | 345/894 | sorghum | *Sorghum bicolor* | 86.22 | 76.44 |
| FUE_14 | 346/895 | sorghum | *Sorghum bicolor* | 86.22 | 77.33 |
| FUE_14 | 347/896 | sorghum | *Sorghum bicolor* | 86.67 | 77.78 |
| FUE_14 | 348/897 | sorghum | *Sorghum bicolor* | 93.33 | 89.78 |
| FUE_14 | 349/898 | sorghum | *Sorghum bicolor* | 93.78 | 89.78 |
| FUE_14 | 350/899 | sorghum | *Sorghum bicolor* | 93.78 | 89.78 |
| FUE_14 | 351/900 | sorghum | *Sorghum bicolor* | 93.78 | 90.22 |
| FUE_14 | 352/901 | sorghum | *Sorghum bicolor* | 93.78 | 90.22 |
| FUE_14 | 353/902 | sorghum | *Sorghum bicolor* | 94.67 | 90.67 |
| FUE_14 | 354/903 | wheat | *Triticum* spp. | 87.11 | 80.44 |
| FUE_14 | 355/904 | wheat | *Triticum* spp. | 88.89 | 80.89 |
| FUE_14 | 356/905 | wheat | *Triticum* spp. | 87.56 | 81.33 |
| FUE_14 | 357/906 | wheat | *Triticum* spp. | 87.11 | 81.33 |
| FUE_14 | 358/907 | wheat | *Triticum* spp. | 88 | 81.78 |
| FUE_14 | 359/908 | wheat | *Triticum* spp. | 89.33 | 81.78 |
| FUE_14 | 360/909 | wheat | *Triticum* spp. | 90.22 | 83.11 |
| FUE_14 | 361/910 | wheat | *Triticum* spp. | 89.33 | 83.11 |
| FUE_15 | 362/911 | maize | *Zea mays* | 100 | 100 |
| FUE_15 | 363/912 | sorghum | *Sorghum bicolor* | 89.32 | 88.26 |
| FUE_16 | 364/913 | maize | *Zea mays* | 88.21 | 83.59 |
| FUE_16 | 365/914 | maize | *Zea mays* | 100 | 100 |
| FUE_16 | 366/915 | sorghum | *Sorghum bicolor* | 87.69 | 83.59 |
| FUE_17 | 367/916 | barley | *Hordeum vulgare* | 88.84 | 79.68 |
| FUE_17 | 368/917 | barley | *Hordeum vulgare* | 88.84 | 79.68 |
| FUE_17 | 369/918 | maize | *Zea mays* | 94.42 | 88.45 |
| FUE_17 | 370/919 | maize | *Zea mays* | 100 | 100 |
| FUE_17 | 371/920 | maize | *Zea mays* | 100 | 100 |
| FUE_17 | 372/921 | rice | *Oryza sativa* | 89.24 | 78.49 |

TABLE 50-continued

| Gene | SEQ ID NO: Polynucleotide/polypeptide | organism | Species | coverage | percent_identity |
|---|---|---|---|---|---|
| FUE_17 | 373/922 | sorghum | Sorghum bicolor | 96.02 | 92.03 |
| FUE_17 | 374/923 | wheat | Triticum spp. | 88.45 | 79.28 |
| FUE_17 | 375/924 | wheat | Triticum spp. | 89.64 | 80.08 |
| FUE_30 | 376/925 | maize | Zea mays | 97.8 | 97.8 |
| FUE_30 | 377/926 | maize | Zea mays | 98.31 | 97.97 |
| FUE_30 | 378/927 | maize | Zea mays | 99.66 | 99.66 |
| FUE_30 | 379/928 | maize | Zea mays | 99.83 | 99.83 |
| FUE_30 | 380/929 | maize | Zea mays | 99.83 | 99.83 |
| FUE_30 | 381/930 | rice | Oryza sativa | 87.46 | 79.15 |
| FUE_30 | 382/931 | rice | Oryza sativa | 87.46 | 79.15 |
| FUE_30 | 383/932 | sorghum | Sorghum bicolor | 91.69 | 85.93 |
| FUE_30 | 384/933 | sugarcane | Saccharum officinarum | 92.03 | 87.29 |
| FUE_31 | 385/934 | maize | Zea mays | 99.15 | 98.98 |
| FUE_31 | 386/935 | rice | Oryza sativa | 88.05 | 81.74 |
| FUE_31 | 387/936 | rice | Oryza sativa | 88.05 | 81.74 |
| FUE_31 | 388/937 | wheat | Triticum spp. | 85.15 | 75.94 |
| FUE_32 | 389/938 | maize | Zea mays | 100 | 100 |
| FUE_32 | 390/939 | rice | Oryza sativa | 89.47 | 85.65 |
| FUE_33 | 391/940 | barley | Hordeum vulgare | 92.8 | 88.64 |
| FUE_33 | 392/941 | barley | Hordeum vulgare | 93.63 | 89.75 |
| FUE_33 | 393/942 | maize | Zea mays | 99.72 | 99.72 |
| FUE_33 | 394/943 | maize | Zea mays | 99.72 | 99.72 |
| FUE_33 | 395/944 | rice | Oryza sativa | 93.35 | 90.3 |
| FUE_33 | 396/945 | rice | Oryza sativa | 93.63 | 90.58 |
| FUE_33 | 397/946 | sorghum | Sorghum bicolor | 85.32 | 75.35 |
| FUE_33 | 398/947 | sorghum | Sorghum bicolor | 85.32 | 75.35 |
| FUE_33 | 399/948 | sorghum | Sorghum bicolor | 97.51 | 96.68 |
| FUE_33 | 400/949 | sorghum | Sorghum bicolor | 97.78 | 96.95 |
| FUE_33 | 401/950 | sugarcane | Saccharum officinarum | 85.04 | 75.9 |
| FUE_33 | 402/951 | sugarcane | Saccharum officinarum | 97.51 | 96.68 |
| FUE_33 | 403/952 | wheat | Triticum spp. | 93.35 | 89.75 |
| FUE_34_Evo | 404/953 | maize | Zea mays | 96.25 | 94.58 |
| FUE_34_Evo | 405/954 | maize | Zea mays | 96.25 | 94.58 |
| FUE_34_Evo | 406/955 | rice | Oryza sativa | 86.25 | 76.67 |
| FUE_34_Evo | 407/956 | rice | Oryza sativa | 87.92 | 78.33 |
| FUE_34_Evo | 408/957 | rice | Oryza sativa | 92.5 | 85.83 |
| FUE_34_Evo | 409/958 | rice | Oryza sativa | 92.92 | 86.25 |
| FUE_34_Evo | 410/959 | wheat | Triticum spp. | 87.5 | 78.75 |
| FUE_34_Pat | 411/960 | maize | Zea mays | 100 | 100 |
| FUE_34_Pat | 412/961 | rice | Oryza sativa | 85.83 | 76.67 |
| FUE_34_Pat | 413/962 | rice | Oryza sativa | 87.5 | 78.33 |
| FUE_34_Pat | 414/963 | rice | Oryza sativa | 92.08 | 85.42 |
| FUE_34_Pat | 415/964 | rice | Oryza sativa | 92.5 | 85.83 |
| FUE_34_Pat | 416/965 | wheat | Triticum spp. | 87.5 | 78.75 |
| FUE_35 | 417/966 | maize | Zea mays | 98.41 | 96.03 |
| FUE_35 | 418/967 | maize | Zea mays | 100 | 97.62 |
| FUE_35 | 419/968 | maize | Zea mays | 100 | 100 |
| FUE_36 | 420/969 | Arabidopsis | Arabidopsis thaliana | 87.43 | 74.86 |
| FUE_36 | 421/970 | Arabidopsis | Arabidopsis thaliana | 87.98 | 75.41 |
| FUE_36 | 422/971 | Arabidopsis | Arabidopsis thaliana | 90.16 | 77.87 |
| FUE_36 | 423/972 | Arabidopsis | Arabidopsis thaliana | 90.16 | 77.87 |
| FUE_36 | 424/973 | Arabidopsis | Arabidopsis thaliana | 90.98 | 80.87 |
| FUE_36 | 425/974 | Arabidopsis | Arabidopsis thaliana | 92.35 | 82.51 |
| FUE_36 | 426/975 | Arabidopsis | Arabidopsis thaliana | 92.35 | 82.51 |
| FUE_36 | 427/976 | barley | Hordeum vulgare | 87.43 | 79.51 |
| FUE_36 | 428/977 | barley | Hordeum vulgare | 87.43 | 79.51 |
| FUE_36 | 429/978 | barley | Hordeum vulgare | 87.7 | 80.05 |
| FUE_36 | 430/979 | barley | Hordeum vulgare | 92.35 | 86.34 |
| FUE_36 | 431/980 | barley | Hordeum vulgare | 97.27 | 93.72 |
| FUE_36 | 432/981 | barley | Hordeum vulgare | 97.27 | 93.72 |
| FUE_36 | 433/982 | cotton | Gossypium ssp. | 87.16 | 77.87 |
| FUE_36 | 434/983 | cotton | Gossypium ssp. | 85.79 | 78.42 |
| FUE_36 | 435/984 | cotton | Gossypium ssp. | 89.89 | 82.24 |
| FUE_36 | 436/985 | cotton | Gossypium ssp. | 90.16 | 82.79 |
| FUE_36 | 437/986 | maize | Zea mays | 91.8 | 84.97 |
| FUE_36 | 438/987 | maize | Zea mays | 98.91 | 98.91 |
| FUE_36 | 439/988 | maize | Zea mays | 98.91 | 98.91 |
| FUE_36 | 440/989 | maize | Zea mays | 100 | 99.73 |
| FUE_36 | 441/990 | poplar | Populus spp | 91.53 | 83.06 |
| FUE_36 | 442/991 | poplar | Populus spp | 91.53 | 83.33 |
| FUE_36 | 443/992 | rice | Oryza sativa | 90.98 | 83.06 |
| FUE_36 | 444/993 | rice | Oryza sativa | 90.98 | 83.06 |
| FUE_36 | 445/994 | rice | Oryza sativa | 91.26 | 86.61 |
| FUE_36 | 446/995 | rice | Oryza sativa | 91.26 | 86.61 |
| FUE_36 | 447/996 | rice | Oryza sativa | 96.17 | 92.9 |
| FUE_36 | 448/997 | rice | Oryza sativa | 96.17 | 92.9 |
| FUE_36 | 449/998 | sorghum | Sorghum bicolor | 92.62 | 87.16 |

TABLE 50-continued

| Gene | SEQ ID NO: Polynucleotide/polypeptide | organism | Species | coverage | percent_identity |
|---|---|---|---|---|---|
| FUE_36 | 450/999 | sorghum | Sorghum bicolor | 99.18 | 99.18 |
| FUE_36 | 451/1000 | sorghum | Sorghum bicolor | 99.18 | 99.18 |
| FUE_36 | 452/1001 | soybean | Glycine max | 87.7 | 77.87 |
| FUE_36 | 453/1002 | soybean | Glycine max | 89.34 | 78.96 |
| FUE_36 | 454/1003 | soybean | Glycine max | 89.34 | 79.51 |
| FUE_36 | 455/1004 | soybean | Glycine max | 89.34 | 79.51 |
| FUE_36 | 456/1005 | soybean | Glycine max | 89.62 | 79.78 |
| FUE_36 | 457/1006 | soybean | Glycine max | 92.35 | 84.15 |
| FUE_36 | 458/1007 | sugarcane | Saccharum officinarum | 98.91 | 98.63 |
| FUE_36 | 459/1008 | sugarcane | Saccharum officinarum | 98.91 | 98.91 |
| FUE_36 | 460/1009 | sunflower | Helianthus annuus | 87.43 | 76.78 |
| FUE_36 | 461/1010 | tobacco | Nicotiana spp. | 91.53 | 83.61 |
| FUE_36 | 462/1011 | tomato | Solanum lycopersicum | 87.7 | 78.69 |
| FUE_36 | 463/1012 | tomato | Solanum lycopersicum | 87.7 | 78.69 |
| FUE_36 | 464/1013 | tomato | Solanum lycopersicum | 92.62 | 84.7 |
| FUE_36 | 465/1014 | wheat | Triticum spp. | 86.89 | 80.05 |
| FUE_36 | 466/1015 | wheat | Triticum spp. | 91.53 | 85.52 |
| FUE_36 | 467/1016 | wheat | Triticum spp. | 97.27 | 93.99 |
| FUE_37 | 468/1017 | barley | Hordeum vulgare | 91.55 | 83.1 |
| FUE_37 | 469/1018 | barley | Hordeum vulgare | 91.55 | 83.1 |
| FUE_37 | 470/1019 | maize | Zea mays | 100 | 100 |
| FUE_37 | 471/1020 | rice | Oryza sativa | 95.07 | 88.03 |
| FUE_37 | 472/1021 | rice | Oryza sativa | 95.07 | 88.03 |
| FUE_37 | 473/1022 | sugarcane | Saccharum officinarum | 97.18 | 93.66 |
| FUE_37 | 474/1023 | wheat | Triticum spp. | 91.55 | 83.1 |
| FUE_38 | 475/1024 | Arabidopsis | Arabidopsis thaliana | 86.79 | 69.97 |
| FUE_38 | 476/1025 | Arabidopsis | Arabidopsis thaliana | 86.79 | 69.97 |
| FUE_38 | 477/1026 | Arabidopsis | Arabidopsis thaliana | 86.79 | 70.27 |
| FUE_38 | 478/1027 | Arabidopsis | Arabidopsis thaliana | 85.89 | 73.27 |
| FUE_38 | 479/1028 | Arabidopsis | Arabidopsis thaliana | 85.89 | 73.27 |
| FUE_38 | 480/1029 | Arabidopsis | Arabidopsis thaliana | 85.89 | 73.27 |
| FUE_38 | 481/1030 | barley | Hordeum vulgare | 85.29 | 67.57 |
| FUE_38 | 482/1031 | barley | Hordeum vulgare | 85.29 | 67.57 |
| FUE_38 | 483/1032 | barley | Hordeum vulgare | 85.59 | 68.17 |
| FUE_38 | 484/1033 | barley | Hordeum vulgare | 85.89 | 69.37 |
| FUE_38 | 485/1034 | barley | Hordeum vulgare | 85.89 | 69.37 |
| FUE_38 | 486/1035 | barley | Hordeum vulgare | 86.19 | 71.17 |
| FUE_38 | 487/1036 | barley | Hordeum vulgare | 86.19 | 71.17 |
| FUE_38 | 488/1037 | barley | Hordeum vulgare | 85.59 | 73.87 |
| FUE_38 | 489/1038 | cotton | Gossypium ssp. | 85.89 | 69.97 |
| FUE_38 | 490/1039 | cotton | Gossypium ssp. | 85.29 | 69.97 |
| FUE_38 | 491/1040 | cotton | Gossypium ssp. | 85.89 | 72.97 |
| FUE_38 | 492/1041 | cotton | Gossypium ssp. | 87.09 | 72.97 |
| FUE_38 | 493/1042 | cotton | Gossypium ssp. | 85.89 | 73.27 |
| FUE_38 | 494/1043 | cotton | Gossypium ssp. | 86.79 | 73.87 |
| FUE_38 | 495/1044 | cotton | Gossypium ssp. | 86.49 | 74.17 |
| FUE_38 | 496/1045 | cotton | Gossypium ssp. | 89.79 | 77.48 |
| FUE_38 | 497/1046 | grape | Vitis ssp. | 86.79 | 72.97 |
| FUE_38 | 498/1047 | grape | Vitis ssp. | 86.79 | 72.97 |
| FUE_38 | 499/1048 | grape | Vitis ssp. | 90.09 | 80.18 |
| FUE_38 | 500/1049 | maize | Zea mays | 85.29 | 67.87 |
| FUE_38 | 501/1050 | maize | Zea mays | 85.29 | 67.87 |
| FUE_38 | 502/1051 | maize | Zea mays | 85.29 | 68.47 |
| FUE_38 | 503/1052 | maize | Zea mays | 85.59 | 71.17 |
| FUE_38 | 504/1053 | maize | Zea mays | 85.89 | 71.17 |
| FUE_38 | 505/1054 | maize | Zea mays | 85.89 | 71.17 |
| FUE_38 | 506/1055 | maize | Zea mays | 85.89 | 71.17 |
| FUE_38 | 507/1056 | maize | Zea mays | 85.89 | 71.47 |
| FUE_38 | 508/1057 | maize | Zea mays | 85.89 | 71.47 |
| FUE_38 | 509/1058 | maize | Zea mays | 86.19 | 73.87 |
| FUE_38 | 510/1059 | maize | Zea mays | 86.19 | 74.77 |
| FUE_38 | 511/1060 | maize | Zea mays | 86.19 | 74.77 |
| FUE_38 | 512/1061 | maize | Zea mays | 100 | 100 |
| FUE_38 | 513/1062 | poplar | Populus spp | 89.49 | 79.28 |
| FUE_38 | 514/1063 | poplar | Populus spp | 89.49 | 79.88 |
| FUE_38 | 515/1064 | rice | Oryza sativa | 85.59 | 68.17 |
| FUE_38 | 516/1065 | rice | Oryza sativa | 85.59 | 68.17 |
| FUE_38 | 517/1066 | rice | Oryza sativa | 85.59 | 68.77 |
| FUE_38 | 518/1067 | rice | Oryza sativa | 85.59 | 68.77 |
| FUE_38 | 519/1068 | rice | Oryza sativa | 87.39 | 72.07 |
| FUE_38 | 520/1069 | rice | Oryza sativa | 87.39 | 72.07 |
| FUE_38 | 521/1070 | rice | Oryza sativa | 86.79 | 73.57 |
| FUE_38 | 522/1071 | rice | Oryza sativa | 86.79 | 73.57 |
| FUE_38 | 523/1072 | rice | Oryza sativa | 85.89 | 73.87 |
| FUE_38 | 524/1073 | rice | Oryza sativa | 85.89 | 73.87 |
| FUE_38 | 525/1074 | rice | Oryza sativa | 86.79 | 75.38 |
| FUE_38 | 526/1075 | rice | Oryza sativa | 86.79 | 75.38 |

TABLE 50-continued

| Gene | SEQ ID NO: Polynucleotide/polypeptide | organism | Species | coverage | percent_identity |
|---|---|---|---|---|---|
| FUE_38 | 527/1076 | rice | *Oryza sativa* | 96.4 | 91.59 |
| FUE_38 | 528/1077 | rice | *Oryza sativa* | 96.4 | 91.59 |
| FUE_38 | 529/1078 | *sorghum* | *Sorghum bicolor* | 85.29 | 67.87 |
| FUE_38 | 530/1079 | *sorghum* | *Sorghum bicolor* | 85.29 | 67.87 |
| FUE_38 | 531/1080 | *sorghum* | *Sorghum bicolor* | 86.19 | 69.07 |
| FUE_38 | 532/1081 | *sorghum* | *Sorghum bicolor* | 85.89 | 71.77 |
| FUE_38 | 533/1082 | *sorghum* | *Sorghum bicolor* | 87.39 | 72.07 |
| FUE_38 | 534/1083 | *sorghum* | *Sorghum bicolor* | 99.1 | 97.6 |
| FUE_38 | 535/1084 | *sorghum* | *Sorghum bicolor* | 99.1 | 97.6 |
| FUE_38 | 536/1085 | soybean | *Glycine max* | 85.29 | 67.27 |
| FUE_38 | 537/1086 | soybean | *Glycine max* | 85.29 | 67.87 |
| FUE_38 | 538/1087 | soybean | *Glycine max* | 85.89 | 69.67 |
| FUE_38 | 539/1088 | soybean | *Glycine max* | 86.49 | 71.47 |
| FUE_38 | 540/1089 | soybean | *Glycine max* | 86.79 | 71.77 |
| FUE_38 | 541/1090 | soybean | *Glycine max* | 85.89 | 72.67 |
| FUE_38 | 542/1091 | soybean | *Glycine max* | 85.29 | 73.27 |
| FUE_38 | 543/1092 | soybean | *Glycine max* | 86.79 | 74.17 |
| FUE_38 | 544/1093 | soybean | *Glycine max* | 86.79 | 74.17 |
| FUE_38 | 545/1094 | soybean | *Glycine max* | 85.59 | 75.38 |
| FUE_38 | 546/1095 | soybean | *Glycine max* | 88.29 | 77.78 |
| FUE_38 | 547/1096 | soybean | *Glycine max* | 88.29 | 78.08 |
| FUE_38 | 548/1097 | soybean | *Glycine max* | 88.89 | 78.38 |
| FUE_38 | 549/1098 | sugarcane | *Saccharum officinarum* | 85.29 | 67.87 |
| FUE_38 | 550/1099 | sugarcane | *Saccharum officinarum* | 86.49 | 72.07 |
| FUE_38 | 551/1100 | sugarcane | *Saccharum officinarum* | 86.79 | 75.08 |
| FUE_38 | 552/1101 | sugarcane | *Saccharum officinarum* | 99.4 | 97.9 |
| FUE_38 | 553/1102 | tobacco | *Nicotiana* spp. | 86.79 | 72.97 |
| FUE_38 | 554/1103 | tobacco | *Nicotiana* spp. | 86.79 | 72.97 |
| FUE_38 | 555/1104 | tobacco | *Nicotiana* spp. | 87.39 | 75.38 |
| FUE_38 | 556/1105 | tobacco | *Nicotiana* spp. | 87.99 | 76.28 |
| FUE_38 | 557/1106 | tobacco | *Nicotiana* spp. | 87.99 | 76.28 |
| FUE_38 | 558/1107 | tomato | *Solanum lycopersicum* | 86.19 | 69.67 |
| FUE_38 | 559/1108 | tomato | *Solanum lycopersicum* | 86.49 | 72.37 |
| FUE_38 | 560/1109 | tomato | *Solanum lycopersicum* | 90.69 | 78.38 |
| FUE_38 | 561/1110 | tomato | *Solanum lycopersicum* | 90.69 | 78.38 |
| FUE_38 | 562/1111 | wheat | *Triticum* spp. | 85.59 | 68.17 |
| FUE_38 | 563/1112 | wheat | *Triticum* spp. | 85.89 | 69.67 |
| FUE_38 | 564/1113 | wheat | *Triticum* spp. | 86.19 | 71.17 |
| FUE_38 | 565/1114 | wheat | *Triticum* spp. | 85.89 | 71.47 |
| FUE_38 | 566/1115 | wheat | *Triticum* spp. | 85.89 | 71.47 |
| FUE_38 | 567/1116 | wheat | *Triticum* spp. | 86.49 | 71.77 |
| FUE_38 | 568/1117 | wheat | *Triticum* spp. | 85.59 | 73.57 |
| FUE_38 | 569/1118 | wheat | *Triticum* spp. | 93.69 | 86.49 |
| FUE_39 | 570/1119 | *Arabidopsis* | *Arabidopsis thaliana* | 91.93 | 81.17 |
| FUE_39 | 571/1120 | *Arabidopsis* | *Arabidopsis thaliana* | 91.93 | 81.17 |
| FUE_39 | 572/1121 | *Arabidopsis* | *Arabidopsis thaliana* | 91.93 | 81.17 |
| FUE_39 | 573/1122 | *Arabidopsis* | *Arabidopsis thaliana* | 91.48 | 81.61 |
| FUE_39 | 574/1123 | *Arabidopsis* | *Arabidopsis thaliana* | 91.48 | 81.61 |
| FUE_39 | 575/1124 | canola | *Brassica* ssp. | 90.13 | 79.82 |
| FUE_39 | 576/1125 | barley | *Hordeum vulgare* | 93.27 | 79.82 |
| FUE_39 | 577/1126 | barley | *Hordeum vulgare* | 93.27 | 79.82 |
| FUE_39 | 578/1127 | barley | *Hordeum vulgare* | 90.58 | 80.72 |
| FUE_39 | 579/1128 | barley | *Hordeum vulgare* | 90.58 | 80.72 |
| FUE_39 | 580/1129 | barley | *Hordeum vulgare* | 98.65 | 94.62 |
| FUE_39 | 581/1130 | barley | *Hordeum vulgare* | 98.65 | 94.62 |
| FUE_39 | 582/1131 | cotton | *Gossypium* ssp. | 93.27 | 80.72 |
| FUE_39 | 583/1132 | cotton | *Gossypium* ssp. | 93.27 | 81.61 |
| FUE_39 | 584/1133 | cotton | *Gossypium* ssp. | 94.17 | 82.06 |
| FUE_39 | 585/1134 | cotton | *Gossypium* ssp. | 94.62 | 82.06 |
| FUE_39 | 586/1135 | cotton | *Gossypium* ssp. | 94.17 | 82.06 |
| FUE_39 | 587/1136 | cotton | *Gossypium* ssp. | 94.17 | 82.96 |
| FUE_39 | 588/1137 | cotton | *Gossypium* ssp. | 95.07 | 83.86 |
| FUE_39 | 589/1138 | grape | *Vitis* ssp. | 93.72 | 82.96 |
| FUE_39 | 590/1139 | grape | *Vitis* ssp. | 93.27 | 82.96 |
| FUE_39 | 591/1140 | grape | *Vitis* ssp. | 93.72 | 82.96 |
| FUE_39 | 592/1141 | maize | *Zea mays* | 94.62 | 78.92 |
| FUE_39 | 593/1142 | maize | *Zea mays* | 93.27 | 79.82 |
| FUE_39 | 594/1143 | maize | *Zea mays* | 92.83 | 80.27 |
| FUE_39 | 595/1144 | maize | *Zea mays* | 93.27 | 80.72 |
| FUE_39 | 596/1145 | maize | *Zea mays* | 94.17 | 80.72 |
| FUE_39 | 597/1146 | maize | *Zea mays* | 100 | 100 |
| FUE_39 | 598/1147 | maize | *Zea mays* | 100 | 100 |
| FUE_39 | 599/1148 | peach | *Prunus persica* | 93.27 | 81.17 |
| FUE_39 | 600/1149 | poplar | *Populus spp* | 93.27 | 82.06 |
| FUE_39 | 601/1150 | poplar | *Populus spp* | 93.27 | 82.06 |
| FUE_39 | 602/1151 | poplar | *Populus spp* | 92.38 | 82.51 |
| FUE_39 | 603/1152 | poplar | *Populus spp* | 94.17 | 82.96 |

TABLE 50-continued

| Gene | SEQ ID NO: Polynucleotide/polypeptide | organism | Species | coverage | percent_identity |
|---|---|---|---|---|---|
| FUE_39 | 604/1153 | poplar | *Populus spp* | 94.17 | 82.96 |
| FUE_39 | 605/1154 | rice | *Oryza sativa* | 94.62 | 80.72 |
| FUE_39 | 606/1155 | rice | *Oryza sativa* | 94.62 | 81.17 |
| FUE_39 | 607/1156 | rice | *Oryza sativa* | 93.72 | 82.96 |
| FUE_39 | 608/1157 | rice | *Oryza sativa* | 93.72 | 82.96 |
| FUE_39 | 609/1158 | rice | *Oryza sativa* | 95.07 | 91.93 |
| FUE_39 | 610/1159 | rice | *Oryza sativa* | 95.07 | 91.93 |
| FUE_39 | 611/1160 | *sorghum* | *Sorghum bicolor* | 95.52 | 81.17 |
| FUE_39 | 612/1161 | *sorghum* | *Sorghum bicolor* | 95.52 | 81.17 |
| FUE_39 | 613/1162 | *sorghum* | *Sorghum bicolor* | 99.55 | 98.65 |
| FUE_39 | 614/1163 | soybean | *Glycine max* | 93.72 | 82.51 |
| FUE_39 | 615/1164 | soybean | *Glycine max* | 93.72 | 82.51 |
| FUE_39 | 616/1165 | soybean | *Glycine max* | 94.62 | 83.41 |
| FUE_39 | 617/1166 | soybean | *Glycine max* | 94.62 | 83.41 |
| FUE_39 | 618/1167 | sugarcane | *Saccharum officinarum* | 94.17 | 81.61 |
| FUE_39 | 619/1168 | sunflower | *Helianthus annuus* | 91.03 | 77.13 |
| FUE_39 | 620/1169 | sunflower | *Helianthus annuus* | 93.27 | 82.96 |
| FUE_39 | 621/1170 | tobacco | *Nicotiana* spp. | 87 | 77.58 |
| FUE_39 | 622/1171 | tobacco | *Nicotiana* spp. | 89.69 | 78.92 |
| FUE_39 | 623/1172 | tobacco | *Nicotiana* spp. | 92.83 | 82.51 |
| FUE_39 | 624/1173 | tomato | *Solanum lycopersicum* | 89.69 | 79.82 |
| FUE_39 | 625/1174 | tomato | *Solanum lycopersicum* | 91.48 | 81.17 |
| FUE_39 | 626/1175 | tomato | *Solanum lycopersicum* | 92.38 | 82.51 |
| FUE_39 | 627/1176 | wheat | *Triticum* spp. | 93.27 | 79.82 |
| FUE_39 | 628/1177 | wheat | *Triticum* spp. | 92.83 | 82.96 |
| FUE_39 | 629/1178 | wheat | *Triticum* spp. | 99.1 | 94.62 |
| FUE_41 | 630/1179 | maize | *Zea mays* | 98.76 | 98.76 |
| FUE_41 | 631/1180 | maize | *Zea mays* | 100 | 100 |
| FUE_41 | 632/1181 | *sorghum* | *Sorghum bicolor* | 96.27 | 92.55 |
| FUE_41 | 633/1182 | *sorghum* | *Sorghum bicolor* | 96.89 | 93.79 |
| FUE_41 | 634/1183 | *sorghum* | *Sorghum bicolor* | 96.89 | 93.79 |
| FUE_43 | 635/1184 | barley | *Hordeum vulgare* | 91.27 | 85.71 |
| FUE_43 | 636/1185 | barley | *Hordeum vulgare* | 91.27 | 85.71 |
| FUE_43 | 637/1186 | maize | *Zea mays* | 100 | 100 |
| FUE_43 | 638/1187 | rice | *Oryza sativa* | 90.48 | 85.71 |
| FUE_43 | 639/1188 | rice | *Oryza sativa* | 90.48 | 85.71 |
| FUE_43 | 640/1189 | *sorghum* | *Sorghum bicolor* | 99.21 | 97.62 |
| FUE_43 | 641/1190 | *sorghum* | *Sorghum bicolor* | 99.21 | 97.62 |
| FUE_43 | 642/1191 | sugarcane | *Saccharum officinarum* | 86.51 | 85.71 |
| FUE_43 | 643/1192 | sugarcane | *Saccharum officinarum* | 98.41 | 97.62 |
| FUE_43 | 644/1193 | wheat | *Triticum* spp. | 91.27 | 85.71 |
| FUE_44 | 645/1194 | barley | *Hordeum vulgare* | 87.72 | 83.04 |
| FUE_44 | 646/1195 | barley | *Hordeum vulgare* | 88.3 | 84.21 |
| FUE_44 | 647/1196 | maize | *Zea mays* | 98.83 | 98.25 |
| FUE_44 | 648/1197 | rice | *Oryza sativa* | 90.06 | 80.7 |
| FUE_44 | 649/1198 | rice | *Oryza sativa* | 91.81 | 85.38 |
| FUE_44 | 650/1199 | *sorghum* | *Sorghum bicolor* | 86.55 | 82.46 |
| FUE_44 | 651/1200 | *sorghum* | *Sorghum bicolor* | 96.49 | 91.81 |
| FUE_44 | 652/1201 | sugarcane | *Saccharum officinarum* | 93.57 | 86.55 |
| FUE_44 | 653/1202 | sugarcane | *Saccharum officinarum* | 94.74 | 87.72 |
| FUE_44 | 654/1203 | sugarcane | *Saccharum officinarum* | 97.08 | 91.81 |
| FUE_44 | 655/1204 | sugarcane | *Saccharum officinarum* | 97.08 | 92.4 |
| FUE_44 | 656/1205 | wheat | *Triticum* spp. | 87.72 | 83.63 |
| FUE_44 | 657/1206 | wheat | *Triticum* spp. | 88.89 | 84.21 |
| FUE_44 | 658/1207 | wheat | *Triticum* spp. | 88.89 | 84.8 |
| FUE_44 | 659/1208 | wheat | *Triticum* spp. | 90.64 | 85.96 |
| FUE_45 | 660/1209 | barley | *Hordeum vulgare* | 86.83 | 78.44 |
| FUE_45 | 661/1210 | barley | *Hordeum vulgare* | 86.83 | 78.44 |
| FUE_45 | 662/1211 | maize | *Zea mays* | 98.2 | 94.01 |
| FUE_45 | 663/1212 | maize | *Zea mays* | 100 | 100 |
| FUE_45 | 664/1213 | rice | *Oryza sativa* | 88.62 | 80.24 |
| FUE_45 | 665/1214 | rice | *Oryza sativa* | 88.62 | 80.24 |
| FUE_45 | 666/1215 | *sorghum* | *Sorghum bicolor* | 100 | 98.2 |
| FUE_45 | 667/1216 | sugarcane | *Saccharum officinarum* | 100 | 98.2 |
| FUE_45 | 668/1217 | wheat | *Triticum* spp. | 85.03 | 76.65 |
| FUE_45 | 669/1218 | wheat | *Triticum* spp. | 85.03 | 77.25 |
| FUE_45 | 670/1219 | wheat | *Triticum* spp. | 85.03 | 77.25 |
| FUE_45 | 671/1220 | wheat | *Triticum* spp. | 85.63 | 77.84 |
| FUE_45 | 672/1221 | wheat | *Triticum* spp. | 97.01 | 95.21 |
| FUE_46 | 673/1222 | maize | *Zea mays* | 100 | 100 |
| FUE_47 | 674/1223 | maize | *Zea mays* | 89.72 | 85.77 |
| FUE_47 | 675/1224 | maize | *Zea mays* | 100 | 100 |
| FUE_47 | 676/1225 | maize | *Zea mays* | 100 | 100 |
| FUE_47 | 677/1226 | maize | *Zea mays* | 100 | 100 |
| FUE_47 | 678/1227 | sugarcane | *Saccharum officinarum* | 88.14 | 86.17 |
| FUE_48 | 679/1228 | barley | *Hordeum vulgare* | 89.29 | 81.75 |
| FUE_48 | 680/1229 | maize | *Zea mays* | 86.24 | 79.76 |

TABLE 50-continued

| Gene | SEQ ID NO: Polynucleotide/polypeptide | organism | Species | coverage | percent_identity |
|---|---|---|---|---|---|
| FUE_48 | 681/1230 | maize | Zea mays | 99.21 | 99.07 |
| FUE_48 | 682/1231 | maize | Zea mays | 99.34 | 99.21 |
| FUE_48 | 683/1232 | rice | Oryza sativa | 86.64 | 79.23 |
| FUE_48 | 684/1233 | rice | Oryza sativa | 86.64 | 79.23 |
| FUE_48 | 685/1234 | rice | Oryza sativa | 86.64 | 79.23 |
| FUE_48 | 686/1235 | rice | Oryza sativa | 90.34 | 84.26 |
| FUE_48 | 687/1236 | rice | Oryza sativa | 90.34 | 84.26 |
| FUE_48 | 688/1237 | sorghum | Sorghum bicolor | 94.05 | 90.61 |
| FUE_48 | 689/1238 | sorghum | Sorghum bicolor | 94.05 | 90.61 |
| FUE_48 | 690/1239 | wheat | Triticum spp. | 89.68 | 81.35 |
| FUE_48 | 691/1240 | wheat | Triticum spp. | 89.42 | 81.61 |
| FUE_49 | 692/1241 | maize | Zea mays | 96.03 | 92.82 |
| FUE_49 | 693/1242 | maize | Zea mays | 98.11 | 97.35 |
| FUE_49 | 694/1243 | maize | Zea mays | 99.24 | 98.68 |
| FUE_49 | 695/1244 | rice | Oryza sativa | 89.04 | 81.1 |
| FUE_49 | 696/1245 | rice | Oryza sativa | 89.04 | 81.1 |
| FUE_49 | 697/1246 | wheat | Triticum spp. | 86.96 | 77.13 |
| FUE_49 | 698/1247 | wheat | Triticum spp. | 87.33 | 77.32 |
| FUE_50 | 699/1248 | maize | Zea mays | 99.73 | 99.73 |
| FUE_50 | 700/1249 | sugarcane | Saccharum officinarum | 91.42 | 88.2 |
| FUE_50 | 701/1250 | sugarcane | Saccharum officinarum | 92.49 | 89.28 |
| FUE_51 | 702/1251 | barley | Hordeum vulgare | 91.5 | 84.75 |
| FUE_51 | 703/1252 | barley | Hordeum vulgare | 91.5 | 84.75 |
| FUE_51 | 704/1253 | barley | Hordeum vulgare | 94.12 | 88.45 |
| FUE_51 | 705/1254 | maize | Zea mays | 100 | 100 |
| FUE_51 | 706/1255 | rice | Oryza sativa | 92.59 | 85.4 |
| FUE_51 | 707/1256 | rice | Oryza sativa | 92.59 | 85.4 |
| FUE_51 | 708/1257 | rice | Oryza sativa | 95.86 | 93.46 |
| FUE_51 | 709/1258 | rice | Oryza sativa | 96.08 | 93.68 |
| FUE_51 | 710/1259 | sorghum | Sorghum bicolor | 92.16 | 83.22 |
| FUE_51 | 711/1260 | sorghum | Sorghum bicolor | 92.16 | 83.22 |
| FUE_51 | 712/1261 | sugarcane | Saccharum officinarum | 92.16 | 83.88 |
| FUE_51 | 713/1262 | sugarcane | Saccharum officinarum | 98.91 | 98.26 |
| FUE_51 | 714/1263 | wheat | Triticum spp. | 91.29 | 84.97 |
| FUE_51 | 715/1264 | wheat | Triticum spp. | 94.77 | 88.89 |
| FUE_52 | 716/1265 | barley | Hordeum vulgare | 89.35 | 83.8 |
| FUE_52 | 717/1266 | barley | Hordeum vulgare | 89.35 | 83.8 |
| FUE_52 | 718/1267 | maize | Zea mays | 100 | 99.77 |
| FUE_52 | 719/1268 | maize | Zea mays | 100 | 99.77 |
| FUE_52 | 720/1269 | rice | Oryza sativa | 90.05 | 85.88 |
| FUE_52 | 721/1270 | rice | Oryza sativa | 90.05 | 86.11 |
| FUE_52 | 722/1271 | rice | Oryza sativa | 90.05 | 86.11 |
| FUE_52 | 723/1272 | sorghum | Sorghum bicolor | 93.06 | 90.97 |
| FUE_52 | 724/1273 | sugarcane | Saccharum officinarum | 94.68 | 92.82 |
| FUE_52 | 725/1274 | wheat | Triticum spp. | 89.35 | 83.33 |
| FUE_53 | 726/1275 | barley | Hordeum vulgare | 86.86 | 73.73 |
| FUE_53 | 727/1276 | maize | Zea mays | 95.98 | 94.37 |
| FUE_53 | 728/1277 | maize | Zea mays | 100 | 100 |
| FUE_53 | 729/1278 | rice | Oryza sativa | 93.57 | 86.86 |
| FUE_53 | 730/1279 | rice | Oryza sativa | 93.57 | 86.86 |
| FUE_53 | 731/1280 | wheat | Triticum spp. | 89.54 | 80.43 |
| FUE_54 | 732/1281 | maize | Zea mays | 90.94 | 88.77 |
| FUE_54 | 733/1282 | maize | Zea mays | 96.74 | 96.74 |
| FUE_54 | 734/1283 | sorghum | Sorghum bicolor | 87.32 | 83.7 |
| FUE_54 | 735/1284 | sorghum | Sorghum bicolor | 87.32 | 83.7 |
| FUE_54 | 736/1285 | sorghum | Sorghum bicolor | 90.22 | 86.59 |
| FUE_54 | 737/1286 | sugarcane | Saccharum officinarum | 90.94 | 87.32 |
| FUE_54 | 738/1287 | sugarcane | Saccharum officinarum | 90.94 | 87.32 |
| FUE_55 | 739/1288 | maize | Zea mays | 92.31 | 89.62 |
| FUE_100 | 740/1289 | barley | Hordeum vulgare | 88.89 | 81.77 |
| FUE_100 | 741/1290 | barley | Hordeum vulgare | 88.89 | 81.77 |
| FUE_100 | 742/1291 | maize | Zea mays | 85.19 | 74.64 |
| FUE_100 | 743/1292 | maize | Zea mays | 85.19 | 74.64 |
| FUE_100 | 744/1293 | maize | Zea mays | 98.29 | 98.01 |
| FUE_100 | 745/1294 | maize | Zea mays | 99.72 | 99.72 |
| FUE_100 | 746/1295 | rice | Oryza sativa | 86.61 | 78.92 |
| FUE_100 | 747/1296 | rice | Oryza sativa | 86.61 | 78.92 |
| FUE_100 | 748/1297 | sorghum | Sorghum bicolor | 85.19 | 74.93 |
| FUE_100 | 749/1298 | sorghum | Sorghum bicolor | 87.46 | 78.06 |
| FUE_100 | 750/1299 | sorghum | Sorghum bicolor | 87.46 | 78.06 |
| FUE_100 | 751/1300 | sorghum | Sorghum bicolor | 92.02 | 88.03 |
| FUE_100 | 752/1301 | sugarcane | Saccharum officinarum | 89.17 | 78.63 |
| FUE_100 | 753/1302 | sugarcane | Saccharum officinarum | 91.45 | 87.75 |
| FUE_100 | 754/1303 | wheat | Triticum spp. | 87.18 | 79.77 |
| FUE_101 | 755/1304 | maize | Zea mays | 100 | 100 |
| FUE_101 | 756/1305 | rice | Oryza sativa | 91.76 | 84.82 |
| FUE_101 | 757/1306 | rice | Oryza sativa | 91.76 | 84.82 |

TABLE 50-continued

| Gene | SEQ ID NO: Polynucleotide/polypeptide | organism | Species | coverage | percent_identity |
|---|---|---|---|---|---|
| FUE_102 | 758/1307 | maize | Zea mays | 87.2 | 83.65 |
| FUE_102 | 759/1308 | maize | Zea mays | 94.31 | 93.84 |
| FUE_102 | 760/1309 | maize | Zea mays | 96.21 | 96.21 |
| FUE_501 | 761/1310 | Arabidopsis | Arabidopsis thaliana | 87.13 | 75.86 |
| FUE_501 | 762/1311 | Arabidopsis | Arabidopsis thaliana | 87.59 | 76.55 |
| FUE_501 | 763/1312 | Arabidopsis | Arabidopsis thaliana | 100 | 100 |
| FUE_502 | 764/1313 | Arabidopsis | Arabidopsis thaliana | 100 | 100 |
| FUE_503 | 765/1314 | Arabidopsis | Arabidopsis thaliana | 100 | 100 |
| FUE_504 | 766/1315 | Arabidopsis | Arabidopsis thaliana | 100 | 100 |
| FUE_505 | 767/1316 | Arabidopsis | Arabidopsis thaliana | 100 | 100 |

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications and GenBank Accession numbers mentioned in this specification are herein incorporated in their entirety by reference into the specification, to the same extent as if each individual publication, patent or patent application or GenBank Accession number was specifically and individually indicated to be incorporated herein by reference. In addition, citation or identification of any reference in this application shall not be construed as an admission that such reference is available as prior art to the present invention.

SEQUENCE LISTING (1514 sequences)

SEQ ID NO: 1 - DNA, 873 bp, Zea mays
attgtgttgggagcagctagcagctcgaactagctttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcggctcgccgccgtacgagccgtgctgctcgctgctggacgggctcgtcgacctggaggccgccgtctgcctctgcaccgccgtcaaggccaacatcctcggcatcaaccttaacctccccatcgacctcagcctcatcctcaacaactgcggcaagaactgccccaacgacttccactgcgcgtagatgatcagtcagtcagttattgatcgtcgtccatcgccggccggccgtggttcatcgtcattattccgttttgcttaattgttgatcgatcgtcttcttcctgtcagtcccagcagcttatttattttaaatttgtctctttatacatatatatgagtggtgtggttacacttctacatagcccaggcagcggctacgacgcgtgcgtgtatatgtctggcctggggtgatcagttaattactgatcggtgttgcgcagtagtgcagtacgtatattcttcatttgtagtcatgacgatctgtttgcatggttcgttcaataaatgaagttgacaagttgtactttctttctcataaaaccgagtatggaattcgtttgaccaaataaacct

SEQ ID NO: 2 - DNA, 781 bp, Oryza sativa
acacacaaagcaagaacctcgagctgatctactagctacctagtactctcatcttcttcactagcttttgcttgatcaattgcagcaatggcggcgaaggcagcgctcgttctagcggtgagcctcctggtggtggccgtggcgagcgcctgcacctactgcccggagccgccgacgccgaagccgaagccgccggcgccgaggccgccgacgcccggcggcggcgccgggtcgtgcccgcgcgacgcgctgaagctgcacgtgtgcgccaacgtgctcggcctcgtgaaggccaagatcggcgcggtggcgccgtacgagccctgctgctcgctgctcgacggcctcgtcgacctcgacgccgccgtctgcctctgcaccgccatcaaggccaacgtgctcggcctcaacctcaacatccccatcgacctcagcctcatcctcaacaactgcggcaagatctgcccatccgactaccagtgtgcttaatcacattgggacactgcagccgatcgatcgatcgatcgattgacagtgtgctacacgtcgtctacatgtttttgttggttggtttactgtgagcagtctgaactctctgaactttggaaactgtctgttttgtctttgtttatgcttgcaaagtttaattagttctgggaaaaaaccattggccagtatgtattattacatgtgtaagtgttggttgtgaccccgggtgatcagtttactggtcaatatatatgtattttttgtgcttatgatctgttatggttcagatgtc

SEQ ID NO: 3 - DNA, 615 bp, Glycine max
gcacgagggttgttgtattgtaattaagcaagaatattaggcaatggagtcttctagaacttcaactactcttgctctttttttaaccatcaatttgcttttctttgtcatggcaagtggctgctacacttgcacacagcctaagccaaaccctatcccattcccttaccctaaccctagtcctgccgcgaagagctgccccagggacgcacttaagctcggagtgtgcgcaaacgtgcttaatggaccaattggtgctattgtagggtcaccaccggaccacccatgttgctcagtgctagaagggcttcttgatcttgaagttgcggtttgcctctgcactgccatcaaagccaacattcttggcattaaccttaacatccccatttcgcttagcttgatacttaacgcctgcgagaagtcgccaccctctgacttcctgtgcaactaggcatagttaattaagcacgtcattctcaattattcatgcactacttaatttaatttcatcgacgtgttttgtttatgtgatttttgtgccctttgtgttgtgatgattcttatgctgttcggacagtgttaactcatttagtgagaattcggttgtacccgtaa

SEQ ID NO: 4 - DNA, 676 bp, Zea mays
gaattccattgtgttgggagcaaagcaaatcaaagcacaacgagaaggtgagaaagagagagagagagagagagagagagctatggggcagtgttcgtcctcccagcacccagaagcagagcagcagaagcagcagcaggcggctgcctgtgttgacatccagaaaaggtttcttcaaactactgtcttcctggcatatatatatagtcgtcgagcgactcaaaccatgcatggtgggtaaggttttcttcttcttcttccwagctgcaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaatcagactgcctccatttgtcgatttacgaaattttatcacttaaacctgtctgtgtatttcagcaatgttttttgtaaaccgtccatgtatatgttgagaaaataatcacggagaccgcccttggtatcgatc

SEQ ID NO: 5 - DNA, 780 bp, Zea mays
gaattccattgtgttgggcaccatccacgcactagtacgtagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcaaggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtggcgtgaggcgtacctgtgtcggtagcagcgtggcccactggacagggacagagtgtggcgttgctcttttctgtttccgtacgtacgtacttggatcgcgcatgcccgtgtatgcgtgttccgttgtggtgttgctgtactcgatctgctgcctgtgtgtatctaccgagctcttcggacagatacgcgtgcgtatgaataattgatgtaataacgacgtgtgcatccgctatatatatgcatatctaaaataaaaagatatcatatcttatattacgagactaaaataaaaagtaattacagcct

SEQ ID NO: 6 - DNA, 661 bp, Hordeum vulgare
  misc_feature (649)..(649): n is a, c, g, or t
acgagggccatacttgcagaggccactagctcactacgtacgagtcgatcaatctgttgtttcagcgagacaccatgaagtacttggcccagctggtggtggcgctcctggccttctcggcagtggtgctgatggtggcgccggcgggcgcggaggcggcgacctgcaacgcgctgcagctgaccccgtgcgcgggggccatcatggggaacgcggcgcccacggcgtcgtgctgcagcaagatgagggagcagcagccttgcatgtgccagtacgcgcgcgaccccaacctcaagcagtacgtcgactcccctaacggcaagaaggtcatggccgcctgcaaggtgcccgtgccctcctgctagatggacgcatatatgatcgatccatacgggagagcgcagcgcgcacgcgggcctctctgtcctctcgctgcatgtttcatgtgtgttcatgtgtcagtgtttcccaacacaatctagctaccctgacgatgtatgtggagttgtggaccgatgtgtatctaaatttctgaatatacgcaataatggtgatgtatccagctatatgtaatttatatgtttcttcctgtggcgtgcacattttcatggcgctctttgtggtagtcatcaattgttataaactaganacaatttccatg

SEQ ID NO: 7 - DNA, 680 bp, Oryza sativa
aggtcatcgtagctagcaatcctatacaaagcaagtagtagcaataactggttcttgatcatttttatctaagttcttaatttcgatcgcgaagggccatggcgaaggtggcgttggcggtggcggcgatggcggtgctgctgctgctcgcggcggcggcggcgccgggggcggaggcggcgtgcgacgcgctgcagctgtcgccgtgcgcgagcgcgatcatcgggaacgcgtcgccgtcggcgtcgtgctgcagccggatgaaggagcagcagccgtgcctgtgccagtacgcgcgcgacccaaacctgcagcgctacgtcaactcccccaacggcaagaaggtcttggccgcctgccacgtccccgtcccctcctgctaaaaccaaaccataatactccagttctgcgtgccgtttatacgtgtgtgagtgcgcctgtcgcatggcccacctgccatagacgccgtctatatatggacgtacgtacgtgtctcgcttacttgatttcgtgtctgcttcgacgagttcgatcgtgccgtgtattgcgtacggttatactgctctgtattgggtatgtatgtatgtatgtatgtatgaataaataaagccagaaatgcagttgtacgagggttaaaaaaaaacaatttatataataatttataaccctatcattataaa

SEQ ID NO: 8 - DNA, 680 bp, Zea mays
gaattccattgtgttgggggcacaccgagctcttgcctgcctccactccacccaatggcgatgccgagggcggcgggcgcggggtcgctccgcttcctgggcctgctgaagcagccggagtccgacgccgccgccccattcgagctcgacgagcgcgacgtggtgtggccggcgggcggggggcagcaggacggttgggccgccccgccggcgccgaggcgtcgcgcgcacgccgtgccgctgtacagcttcgggctgtcgtcgctgctcgccgaaggctgcggcggcggggtgcccgtgcccgtgccggggagggcgatggcgccgagcgccgcgccgaggcagtcggcgccggtgcgcgtgccggcgccgtggccaggcggcaggagggccgacgaggacgaggaggacggcgaggaggtggtgccgccgcacgtggtcgcggcgcggcgccacgcgcggtcgtcgtccgtgctggagggcgccgggcgcacgctcaagggccgcgacctccgcagcgtccgcaacgccgtgctccggcagaccgggttcttggacctgtgaacgtccgcaggcagccatggcagaagacgccgatcgatacattgttgtgtgtctgtgtgtcgttctagtgtcccttacaagttacacatgaagaactgaactcaatacgttcaatc

SEQ ID NO: 9 - DNA, 728 bp, Zea mays
gcacccggtcaaaagcgagggagggtgaagcaccgccgccgtctccgctgccgcacaaagacgagaggaagaggttcccggcgcctccaccaccatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagcccttccactataccagaggacacttccctagggtgttggatagacatggtcgcaagtattctacctctttaccgcaaatcagaacgcatcaaataaaatgcagtggatgaaactgttttttttttgttccaaccaaagtctaattttacttgttcatgccatggtgcattaaccatgggctgtagctgttgttttcagcaaatttgtcttcaaccattattaacctgtgaaatcttcgatcgtgagtgccgttatgacaccgggtgaccggaaatgtcttgact

SEQ ID NO: 10 - DNA, 1680 bp, Oryza sativa
gtatgagccaactgcaaaaacaaaaaagaaaaagaaaaatggcgccaagattaaccgccaaacggcctgcttccctctcctctcgcggcagaaacgcagttcttcagctatggtgtggatcagagaaatggaggattctgcagagccatcgccgcctccccggcggcgtccggtgcagctccggctcgccggacagcggcggcggcggcgccccgccgctcgtcagggcggcggtcagcgccgtcaccgagctactcagggtcctgactcccaagaaccccagagttgttgatgatgatcttcagaagggagatgaaggaggaggaggagcagagttggattcgccgcgcagcgtggatgatgtgattgctgttcttgaagccgattaccagcgagcatatttcctcactgggaactttactccggacatatataccgaagattgcttgtttgaggacccgacaataaagttccgaggaaggtctagatattcccagaacctagatctgcttgtaccgttcttcgacagcccttcacttgagcttgaaaacattgaaaaggggttgagggttgaaacaaagttcatcatggcaacatggacactaaggacatatttaaggcttccatggagacccctcatcgccatcagagggaatacaacatatgatttggatgaagaatacaaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtgggcgaaaaaaaaaagacacctcgcaagaaaaaagaagctactaaaagatacacctaagatgggccggcccatcggcccatcaccgtcgaatgttccacaagcttcgcggcccaaccccaaccacccaaagccaagcaaccgtacggtctcctctctcgtcaaaccaaacccaagcaaagcacccgccacatcggagaagagagagagagagagagagcgtggaagcttctggaaggttctcgaagatgctgtcctccctgtcggcgtggctggtgaacccgcggcggaacccgctggcccgcctccacatgaacgccgtcgcctcccgcctccgcaaatacgggctccggtacgacgacctgtacgacccctaccacgacctcgacatcaaggaggccctggcgcggctgccgcgggaggtggtggacgcccgcaaccagcgcctcaagcgcgccatggacctctccatgaagcaccagtacctccccgccgatgcccaggcgaagcagacaccgttcagaggctatttatctgatatgctagcactggtgaaaaaggagagcgcagagcgcgaagcattgggagcactccccctgtaccagaggaccatcccatgaagcgtctacttcgtaggcctgtttctaattttcttgatgtatgaaagtgaattcaataaaacgcagtggacgattatgtaccatgtattatgctaaaatccttgttgtgtaatgtgttatgtgtatgcttattatgtgaagatacccaccgtcagttctcc

SEQ ID NO: 11 - DNA, 1174 bp, Zea mays
cgataaaaccacgggcgcctctcgtccattcctcgctcgcccaccctccccgcggatcacagacagcctgtgcccgccttccagtccacaatctccctgcctctcctctcccaccctccctccgaaaagcaagctccggcccggaccgccccaccgcgcgcgcgcatacacagagagagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttaggttctgattcgaccggcgggcggaggaaggaattgcagagagggaaaacgaagattccaagggcggaaggggggaaaggcatgcgaaatcagagaggtcttcggtgttactactatgctgttcttggacgtgtttgatttttaatctccttttatatatatatatatatataattttcctacggaggtgggaggagaggaggtggacgaagaatagtgtaatgataatggtggtggtgcagcggcggtggttgagggcccaaaacgatgaacacatggggttgggttgggtgtatgtatctatctgtcacacgcagcttttgtgcaagactattatactacatcgctggtccctccaatttgctcgatcgttcaggctcctaatcatatctgccgaccccccgtatttcctccgcttaaactttttgctcgcggagaatgagaagcactgaagca

SEQ ID NO: 12 - DNA, 1222 bp, Sorghum bicolor
gcacgaggcccaccttcacctcaccagaggccaggccagccgggcggcgtagctacctgcctctgcttctccctctccccgcacagaggctcctagctgccgtgccgccgcgtgacagctccttctctctagtctctacctagctacctctcgtgtcatggcgcagcgcgacaagaaggtggaggagccgacggagctgcgggcgccggagctcacgctgtgcgccaacagctgcggcttcccggggaacccggccaccaacaacctctgccaggcctgcttccaggccgccacggcttcctccgcctcagcctccgtctcgccgccgtcgccttcctcctcgttgtctccgtccccggcggtgttcaagttcgacgagcagcagcacgcgaggccgtctgcgacggcggtgttcgccgaccggcctgcggagcaaccgccggcgccggcgtccgccaggccgatccggacgacgtcgacttcgtcgtcgtcgtccgtcaaccggtgccagagctgccggaagcgcgtcgggctgacggggttccggtgccgctgcggggagctcttctgcggcgcgcaccgctactcggaccgccacgactgctgcttcgactacaaggccgtcggcagggacgccatcgccagggagaaccccgtcgtgcgcgccgccaagatcgtcaggttctgatctgtggtcccgtctcggagcgacaaccagcggcggcggcgtctcgatcggagccggacggacgggcggaggacacacggtggtgatctcggcggagattcggtggatcggtccatctccctctagaattccttccctcctctcttctattttttttccctctcttttcttgctttgtttttctttttttttctattattgttacaagataaaaaattagaaagtgatcgatccatggagggtgttggttattattcattgtcacgctgttcttgacaattataccatccatgaccttgaggaggaggaggaagaaaagcgttggccaaaaagaaagaaaagaaaagaaaagtcatgggaggcagagaagaaggtggggatgaaaagaagagagcgatgataatgttattgtagcggtggtggttgggtggaggcgggaaagaagcgatagggtaacccttcggtttggtgtgttgtcctgcttcaatcacaaatctctatatactttttatatatacccttgtataaaattat

SEQ ID NO: 13 - DNA, 674 bp, Zea mays
cgatttaaaaaactgtttattttctcaacgggatactcgagaaacggtaggacgcttgatcaacaaatcgtgtcgaacacaaaatcaggcgtcttattagtacatgtttacaaatgaagcggcaggccgcacagatcactaattcacattaggatccaacgcaacatttgtttatttgcaattactagctaggatctggttggggggtggaaatgacgataagatttctgaccgcagcagcatcaaatccactcagcttagcagcagcagcatcgatcctagctagatgatcgatcgagctaggcagcttagctagtcctagtcctgcttgacgccggagctgtccttggcggggatctcgtgcaccaccttcacgggcttgagcacgccctcctcgtcgggctgccctgccgaggaccgcacctccaccgtctgcaccgtcttcgtcaccgtctcttgcgccggcttcttgtccgcgccgccagccgcagcgtcgtcgccctgctgggaggcggcgttggtgggggtggtggtcgacatgccgcgcgcggccgatccgatcgagcagcaggtgcagctgcagccgggaggtggaagcaaggcaacaggcaaactctgttgtagcagcgagtagattggttgagtcgggcacaggtgctcacgcccaacacaat

SEQ ID NO: 14 - DNA, 651 bp, Sorghum bicolor
accaatctaaaatcgccgctacacacagagtctgcctgtgttgccttgcctcctctcctccctgccggctgcagctagctcgatcggccgcgcgcggcatgtcgaccaccaccaccaacgccgtgtcccagcagaaggacgctgcggataagaagccggcgcaggagacggtgacgaagacggtgcagacggtggaggtgcggtcgtcggcggggcagcccgacgaggaaggcgtgctcaagcccgtcaaggtggtgcacgagatccctgcgaaggaggccaaggacaactccggcgtcaagcaggactaacggaggagtagctagctcgctactctagatcacgcttcgtgattgatgctcctcctgctgctaagctgcggatgttgctgcggtagctatgtgcaaagatctttccacttccacccgtactagatcctatagtaattaattgctggagagtgccgtcatcacatatggaaatgcagaataaactagtgtcgtgttggtgagcagactttatattgcgtgatccatcgggtttctatgatttacaacaaaagatagcaacctacatcaagaggtgctacatgacgagatcaccataaatacaaactatgccaaactgatcggcattagaagttgttgggtg

SEQ ID NO: 15 - DNA, 985 bp, Hordeum vulgare
gccagctctcatccttctggtagcttcgccggccatactacataagcacccctgcacccagacgctcaaaccaccatcaacttcgatccttccttttgagcagcaatccactctccatccatcttttgtctgcgagatcaggtacatcagcggcatgtcgaccaccgacaacagctcacccaaggacgcacccgcgccagcgagcagcgccccggcggcaggcagcgagccgacggtgacaaagacggtgcagacggtggaggtgaggcagtcggcaggacaggaggaggggcagggggtgatcaagccgatcgaggtggtgcacgagatcccggccaaggagcctgctaccaagcaagagtaacacaacaaatcgagaaagcagcgtgattggtaaactgggggtgtgcgtgtactgttccgcggttgagtgaatcgccgggtgaaacccctgcttttttactttagagaactgataaagtgattggaatatctttgatttcggtaaatgagagcgagcatttttaatgccaataagaatgaccttacgagtactaccggaactgtgctgctgtttcttgatcttcgcgacgaaaaggaaaaatgctgtaatacccgcggacgtggatttgttaaaatatacgggtgtctactctttctctgcaaaaataaataaataatacgtatcactcaaagttatatttttattcatcacatcacatagtcttaattttgtttgaagcgcctgacgggataaccccgggtagactcattaagcctacttctctatacttccgtatacaagggagcaagaacttcctccactgcccgcttcttctgaccggctacgaagttcttgccagcttagagcgtagccgtctactcttctggccggctggctagccgccaaccgactgaagggcagttgttgcatcaatccccaagaatgtgacgtgggccctttgattaaaggcgaaagtccttt

SEQ ID NO: 16 - DNA, 702 bp, Zea mays
ggtttcggcgcgccaacaacaacagatggcaagctgcaggtaaaaggtggaagcaggctgagtgtgaggagccttgacaataatggcaggcgtgttgcggtggaagccgtcaacggcgctgccaggccgaacggcgcagcggcggtggccgacgtccgccggcaagtgcccgcgccgccgccaccggaaggcgacggcgacggcgtcgccttccggctgggtaagtttgcggaagggaggctcgtgtacaggcagcagtttgtggtcagatcctacgagatcgggcctgaccgaactgccaccatggagaccctcatgaacctcctgcaggagacggcactgaaccatgtgatgtgctctgggctcgccggagacggtttcggcgccacacggcagatgagtctcaggaagctcatttgggtcgtcacaagaatcaacatccaggtcgacgagtacagcagatggggagatgtcgtggagatagacacctgggtcgcgtcgtcagggaagaacggcatgcgcagggactggatcatccgcgaccgcaacaccaagaacatgatcgcaagagccacaagcaactgggtgatgatgaacagggagacccggaggctgtcgaaaatccccgacgaggtcaggcaggaggtgctccccttctacctggacaggagcatcatcgccgccgccactggcggcggccgc

SEQ ID NO: 17 - DNA, 402 bp, Sorghum bicolor
gcacgaggccggctcggtaagtttgtggaagggacgcttgtttacagacagcagtttgtgatcagatcctacgagatcgggcctgaccggactgccaccatggagaccctcatgaacctcctgcaggagacagcactgaaccatgtgatgtgctctgggcttgctggagatggtttcggtgccacacttcagatgagcctcaggaagctcatatgggtcgtcacaagaatcaacatccaggtcgacaagtacagcagatggggagatgttgtggagatagacacctgggtggcgtcatcagggaagaacggcatgcgcagagactggatcatccgcgaccgcaacaccaagaacatgattgcaagagccacaagcaactgggtgatgatgaacagagagacc

SEQ ID NO: 18 - DNA, 1843 bp, Oryza sativa
ggtaaaagaaagaggagaaattctcccgtcgtctccttccttgcgccaagaaagacgagccgcggctcaacagcggagtggaggggcgccgatctccatcgccgaggagagcagagcaggggaggggaggggatcctggttagcgcttttggcgtgtgattgatttctaaacgaattttgggccgtgaagggaagttcaatcatggcagggtctcttgccgcctcagcattcttcccaggtccaggctcatctcctgcagcatcagctagaagctccaagaatgctgctgttaccggcgaattgccggagaatttgagtgtccgtggcattgtcgcaaagcctaacccacctcctgcagccatgcaagtaaaggcacaggctcaaacccttcccaaggttaatggtacgaaggttaacctcaagacggtgaagcctgacatggaggaaacggtgccttacagtgctccaaagacgttctataaccaactgccggattggagcatgcttcttgcggctattacaaccatcttccttgccgcagagaagcagtggacactgcttgattggaagccaaagaaacctgacatgcttgttgacacatttggctttggtaggattatccaggacggtatggtgtttaggcagaacttcatgattcggtcctacgagattggtgctgatcgtacagcttctatagagacattgatgaatcatttacaggaaacagctcttaaccatgtgaggactgctggtcttcttggagatggttttggggctacaccggagatgagcaaacggaacttgatatgggttgtcagcaaaatccagcttcttgttgagcaataccccgcatggggagatacggttcaagttgacacatgggttgctgctgctggcaaaaatggcatgcgtcgagactggcatgttcgtgactacaactctggccgaacaatcttgagagctacaagtgtttgggtgatgatgcacaagaaaactagaagactttcaaaaatgccagatgaagttagagctgaaataggcccatatttcaatgaccgttcagctataacagaggagcagagtgaaaagttagccaagacaggaaataaagttggtgatgatgctacagagcaattcataagaaaggggctcactcctagatggggtgacctcgatgtcaatcagcatgtgaacaatgttaaatatattgggtggatccttgagagtgctccaatttcagtactggagaagcatgagcttgcaagcatgaccctggattacaggaaggagtgtggtcgagacagcgtgctgcaatcacttaccaccgtgtcaggggaatgcaccagcattggcgccgacaagcaggcttctgccatccagtgcgaccatcttcttcagcttgagtcaggagctgatattgtgaaggcacacacagagtggcgaccaaagcgatcgcacgcagcagctgagaacgcgtaaacaaacaaaccgacgaaaatctgtgggagggagaatatcaaacttcccttgcctctgttgccctgaagcttatcttgaagtgtgagttgtattctgtaaaaaattagtagtttccatagtgtgaggttggaggggaggtgttggtgcttgcctactgtacctgctacatctattatttcttgattctttgttcgcttttttttttcttttttgtttttaacccctgtggagataagacaggttttgaagtgtggaagaggttgtttcaatcgtctaattgattcaactattcagcaagtaaactgctccatggaatttcatcgtttggttggagcctgagaaatgttgctagttgtttagctt

SEQ ID NO: 19 - DNA, 480 bp, Zea mays
attgtgttgggcgccgtctccagcagagaagaagaagcgacacagctcaactgctcaaggacagcgcagcacgcaagcgggacctcaccgaagcagcacacagcacacaagatcgcacatcctactgctgcgccgcacaatgggcatctgcgtgtcgtgcgacgcggcggacgagggcgccgcgacggcgagggtggtgctccccagcggcgagctccgggagtacgccccgccggccacggccgggacggcgctgcaggcggccggcggcgagggcccctggctcctctgcgacgccgacgggatggcgttcgagggccccgtcgccgtcgcggcggtcgcccccggcgaggagctccaggcggggcagatctacttcgtgctccccgccgagatgcggcgccgccgcctcacccgcgaggaggtcgccgcgctcgccgtcagggccagctcggcgctcgtcaaggccgcggcggccgc

SEQ ID NO: 20 - DNA, 1122 bp, Zea mays
gaattccattgtgttggggctaccataccaaagccactttctctctccatcactcctttaagccawccccaactcccttcactgtatatatgatacatccatccaccattcgtgaggacatcagcatctgtgcgtctcttccacgagaggcaacctaccgtatagtactgccgacatggtgctctccggcggcctagtcgtgccgtggctcgcggcggcggtggcggtggccgcgctggccatcaccgccgccccggtcggcgccgatgcctacaagaactacaccgtcggcgatgacaagggctggtacgacggcctcagcctgcccggggtcgactaccaggcgtgggctgacggcaagaacttcagcctcggggatttcctcatcttcaacacggacaagaaccactcggtggtgcagacgcggaacgtgacgctgtacgagagctgcgactacaacgactcggggcccgacgacaccgtcgagtgggtcgccgcgccgccggagttcagcaaggacgccgtcaccgtcgccgtgccgctcctcgacgagggccgcgcctacttcttctcgggcaactacgacggcgagcagtgcgagagcggccagcgcttcgccgtcgacgtggcccacggccagggcctgccgcctgacctcaggccgcccgtcgccgacgcgccggcgccctcctccgcggggcccgccgacggcgccgccgcgctcgacttcagccaccccaagaacgtcaccacgccgagcgcgacggacgatgacgacgagcaactgggcggtggctcggcctcctccagcctcaggtccgctctgcccgtgaccgcgacgctgctcatcaccttgctcttcgcgttcgcggtgtaggtggcatgcgttagtttcgcttttgtttgtgctgctgctgcttgggcctcataatttgtttgtttaatgcactagtacagttgaagggtttctctgtatagggagagagatgagatatgtttagtgctgtagtagtgtagttgttagtgaaatgctttcacttgtatattctggctgtttatttggtccgtaccgtgctccgtagtaatggatctcgataaaataataattatctcattctttgg

SEQ ID NO: 21 - DNA, 950 bp, Glycine max 1
ggtttctctgtacttcatacattttcacaaaccccaagaagaatggaacagggaagaagaagaagaagctcttttggtcctatgtcctcaactattccttgtcttctcctccttttgttctgtctctcaggatctgctgaggcctacaagaattacacagttggcgactctttaggatggtttgacaatactgagaaatccaatgtcaattaccagaagtgggctgacagtaaagaattcagcttaggagatttcctcattttcaacacggatactaaccactcagtggttcaaacatacaatttcaccacatataaagaatgtgactatgatgatgcacaggataaggacacaacccaatggtcagcagctgatccatccaacacccaaacacatcctgtgacagtgtcagttcctttggtgaaggaagggatgacatacttcttctcaggtgattatgatggtgaccaatgcaagagtggacaacacttcaaaataaatgtgacttatggacaagggttgccaaagagtcttaaatccccagaagatgcaccatctcctgctagtcctgttgctggagatgatgaatcagcgccagacactattgttccttctaatttcagtcaccccaaagaagaaagtgatgatgacaaagctagtgatagtgacaaacagaaatcatctagttctatttcaatctcaatgtatgcacaacttcacattgtcttactagggatactacttttcttgttttaaagagtttggcacgatgttattttatattattttttaattatagatatatgctactattattttatctatttttttattgggtgtgagtgagacagtggggttttgagttgaattgtgagctaggatataccacatgttattgttgtaaactaaaataatgtaacaattaattacaatcctttattgctaatttg

SEQ ID NO: 22 - DNA, 981 bp, Glycine max 2
accaggcctggcagcacaagaatcccatattctcattctcttaagccagtgattagaagccagtttttctgtgcttcatactacaccttcacaaaccccaagaagaatggaacggggaagaagaagcagctcttttggccctatgtcctcaaccgtcccttgttttctcctccttttgttctgtctctcaggatctgctgaggcctacaagaattatacagttggagactctttaggatggtttgacaatactgagaagtccaatgtcaattaccagaagtgggctgacagtaaagaattcagcttgggagatttcctcattttcaactcggacactaaccactcagtggttcagacatacaatttcaccacatacaaagaatgtgactatgatgatgcacaagacaaggacacaacccaatggtcagcttctgatccatccaacacccaaacacatcctgtgacagtggctgttcctttggtgaaggaaggcatgacatacttcttctcaggtgattatgatggtgaccaatgcaagagtggacaacacttcaaaataaatgtgacctatggacaagggttgccaaagagtcttaaatccccagaagatgctccatctcctgctagtcctgttgctggagatgatgattcagcaccagacactattgttccttccaatttcagtcaccccaaagaagaaaatgatgacgacaaagctagtgacgaccagaaatctagtagttctgtttcaattttaatgcatgcacaacttcacattgtcttattagggatactacttttcttgttttaaagagtcaagatttattttatatataaaactacgtaccccattgcccagaggttcttcgctatgcgaaggtatgggggagggatgttgtacgcagccttacccttgcatatacaaagaggctgtttccggattcgaacccatatattttaaatatatgctactattatttt

SEQ ID NO: 23 - DNA, 653 bp, Zea mays
tcaccatcaccaccaatggctcccaaggttgcgctcttccttgccctaagcctcctgttcgctgccgccgcgcatggctgcgaaccctactgtcccggcccagccgtcccaacgccgcccgtcgtgccgtcgcacagccacgggcgctgcccgatcaacgcactaaagctcaaggtgtgcgccaacgtgctggacctcgtcaaggtcggtctaccccagcacgagcaatgttgcccgctgctggaggggctggtggacctcgacgccgcactgtgcctctgcaccgccatcaaggctaacgtcctcggcatccacctcaacgtgccccttagcctcaacctcatcctcaacaattgtggcaagatttgtccaaaggactttacttgccccaactaattgagctgaatatggagataaagccagcatccaaggaatgtaccccttagtgttccatctcgcgattccgattgttacttgatcatcatcgctgtttatctatttttatatttaattatcaataaaaaacattcacattttttgttttgagaaagagagcaaaatatgtgcaccattactattttagaacagtcatgttctctgtctccctgacgagttttccgggaggtatcaataagatagaacgagcgtgatca

SEQ ID NO: 24 - DNA, 900 bp, Zea mays
ggacgagaccagcttscgtttcttcaaggtctatcaatcctagaaaagcttgctgcgcctttggctcctttaattgttgggcgcaccggtgctcaactcttcctcactgatggtgatcctagcaagccacctctcctgttacagatggcatccgactgtgatgacaaaagctacatatcagccttggcagcttttaagaaccgtgtcctctatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgatcgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtcagcatccactgagcggcgaaatatttgggactgggacacacaataagctgtgtatcattatcggccgcctaggttttacattgtttgatgtcaattgtcaaatggcatgtgtttcctcatggaacagacgaagcattcgaagttgatataaagacaacctaaattgtc

SEQ ID NO: 25 - DNA, 925 bp, Hordeum vulgare
gggaggacagatcatttagaggctaatttattctagtagaaagataatgttttttcatcactcaacagatctgcactagcagcttttaagaaccgcattttgtatgctaatgtttcatatgaccatatggttggttggaaaacatcttcaataaggagagaattggaccttagaatgcccttgcgtcgttcacttgatggctacaagtacattgtgaatgtggaatactgttcgcctgtgtcgtccgacgggccccattttccttcgcgggctgcccgagctaaagaagctgcacaaagtacaccgaacatggaaaataccaatgaatatcaccagatgatggaagaggagatgattcgtggtctgcagagagtgggttggaagaaagtagatgtcaacttccatgcatcactgtggccttactctgctcacaacaacatgcatgttaagaatgagtggcttcacaacgctggcgccggtgttatcgcccacgtcgcggacagcatgaaacagacatgcctgccttccaacctgtaagatctggacctggtgtgctggcatatgccacggtcagtactctctatcagcgaacctctgagcttaccagtttccctcctgagcaacacagaggttttaccagtattcgaagctgcagaaagccataaatcgattgctgaaggccaccataccaaacggaggcactttagtggccttagcctaccttcccagcgtttacattcgatgactctccggcagtgctgtaacaaaccctccgctcccagtggtttcgtccccagagctcgctcgggcaagtgctaaagtctgtgtcggactagattgctttctagttttgtttttgaagtctggtttgcactttgaaacaatgtttgtgatatgttctaaaacaaatagacaatgttgaaat

SEQ ID NO: 26 - DNA, 709 bp, Sorghum bicolor
tacaaatggcatctgactgtgatgacaaaaagtacatattagctttagcagcttttaagaaccgtgtcctgtatgcgaacgtttcatatgaccacatggtcggctggcgaacatcttcattaaggagagaaaaagatcttataaagcccttgcatcgttcactggatggctataagcacattgtgaatgttgaatactgttcacccgtatcatcagagggccctcattttccttccaaggctgccagagctaaagaagctgcacagcgaacgccaaacagggaaaataccgaaggataccaccaaatgatggaggaggagatgatccatggcttgcagaaggttggttggaagaaggtggacgtcaacttccattcatcattctggccttactctgctcacaacaacatacatgtaaagaacgagtggcttcacaatgctggtgctggtgttatcgcgcacgttgcagacagcatcaagcagcaggagtcacgggcatgtcttcctgccaatctatagcagtagcatttagcaacccgtttgcttaatttttctgtggctagcaaataaaccgatgccaaattctgatcgtcatcattcactgagcaacgaaatatttgggaccgagacagaataagccgcgtatgtcggcttcaataagttttaccgtgcttgatgtgaattgtcaaatggcttggtttcctcaggaa

SEQ ID NO: 27 - DNA, 884 bp, Zea mays
gcagtcttacagtacgtagcagcagcctagcacgacgatggtgtccggcagcatcagcgaggagatcgccgtggccgtcccggcggagcgcatgtggaaggtggccttcgccgagaccaagtcggcgctcctgcccaaggcctgcgccggctacgtggacgccgtcgaggtcgacggcgacggcgggcccggcagcgtcaccaccatgaagcttaacccatcgctgggtgagaacaagacgctcaagagccgcgtggtggcgttggacgccgcggcgcgcgtggtgaggacggaggtgctgcagggcggcacggtgagcgcgcagctcaggacgcacttcgccgagatcagggtggaggccgccggcgagggcgcctgcgtcgccaaggtcaaggttgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagccgccacctttcctacgtacgtgtatgatcatgccatatggccgtgagtgttttggtttggaataacgggaggaaaggctcctctgtttggttgcttcaattcgcttcgaatcgagtatagaccgacgtttgtgagttggtgtatccgtgctgctacaagtgtgtctacatctatggtctatttatctacatgttcttttgtttgtttgcttcgctgtgcactgtgaggtcgcgtatagacgtattggttgtgttgcaaagaatttgttagatattgagatcgataataatgtatgtatttattcgtttttatgtaattgttgtgttttaaaattttatcgaatatttatatgtagtcgc

SEQ ID NO: 28 - DNA, 837 bp, Hordeum vulgare
cgacattcatgcaccgagcacttagatactatgctcagcagcgctagtgtgcagcgagccagtgaccgacggacaagaacaagatggtcgtcggctgtgtcatcaccgagcagtgcgccctggcggtgtcgacagagcggctgtggaaggtggtctactccggcgaggacacggccgccctgcccaaggcctgcgcaggattcatcgacgccgtggacgtcgagggcgacggcggacccggcagcgtcttcaccatgacgctcagcccggcggcggcggagctgtcaggctcggacgtgatgaagagccgcgtggtggcgcgcgacaacgcggccagggtgttcaagacagaggtgctggagggcgacaaggtaagtggccagctcaagtcacaggcggtcgagatgaagctcgaggcggccggggatggtgcttgcgtggcaaagctcagggtagagtacgagaggctggacggcggcggggcgctgtcggcggaggaccaggcggcgctcgccgccgggtacctcgacctgctcaagatggtcgaggcatacctggtcgcccatcctgccgagtacgcctaattaaaccaaaacgagaaacatcagaaataaatcaactttccctttgttcgaaattatttgtcgcataaataaataaagtaatatgaccaagtagcgtgtgttgtttgcctcctgatcgacttcgggagaaaaatcaattggtaagctttagtataaattattgaggtatatatgagtgtttaatccctgttttaagctcgcatttcgtgtgtaagttgcttcaagcattgatggagataaatatttgagcagt

SEQ ID NO: 29 - DNA, 810 bp, Oryza sativa
  misc_feature (14)..(14): n is a, c, g, or t
  misc_feature (21)..(21): n is a, c, g, or t
  misc_feature (28)..(29): n is a, c, g, or t
aattcgcccttggnacactgnacatggnnactgaaggagtagaaaacaaagcattcaagcaactaggtatctagctaagcagtggtgtgatcagtaggaagttgcaggtgggggatatatcaccaatggctccggtcagcatctccgacgagcgcgccgtctcggtgtcggcggagcgggtgtggaaggtcttctccgacgcgcccgccatgcccaaggtttgtgccggcttcatcgacgccattgaggtcgagggggatggcggggcgggcactgtcaccaccatgaagctcaaccctgctgtggatgatggggggtcattcaaaacacgtgtggtggcacgtgacaacgcagctcacattatcaagtcagaggttctggatgtgccggccggaagtaaggtgggcaagctcaagtcgcacgtgacagagacgaagatcgaggccgccggtgccggctcttgcttggccaagataaacgtggagtatgagctcgaggacggcggctcactgtcgccggagaaggagaagctcatcctcgacggctacttcggcatgctcaagatgatcgaggactacctcgtcgctcaccctaccgagtatgcttaaaaattgtcataaaccaaaataatatacatccatctccgtattgctgcttcctgataattaaataatgtgagccacgacaaatccaatcttttgtggtgtttgattttgtgagagtgatttgtgtttgaggttatgtaagaaataaatcataattgtgatcgtgttctatatgtgtgcaaatgaacatgtttgctgctaaaaa

SEQ ID NO: 30 - DNA, 948 bp, Zea mays
gacaacatcaacaaagcaaacatactgtacacagtagtgccaacattaaatggctgcgtcctcgtacttccttcttgctgcttttctagctgtaacagcttctcatgccaccgcttccgatcctagcccgctccaggatttctgtgttgctgatattcactctcctgtgaaggtgaatggatttgtttgtaaggatcctatggcggtgaccccagatgacttcttcaaagcagccaatcttgataaagctagagacaccatgaagagtaaggtggggtccaatgtcactttgatcaacgtcatccagctccctggcctcaacactcttggcatctccctggcacgtatcgactacgcgccattgggcgagaacccgccgcacacccacccacgtgccacggagatcctcacggttcttgaggggacactctacgtcgggtttgtcacctccaacccaaacaagctatttgccaaggtgctcaacaagggtgatgtgttcgtattcccccaaggtctcatccatttccaattcaacccggtctataacaagccggccgttgctatcgcggcgctcagcagccagaaccctggggttattaccatcgccaatgcggtcttcggatcaaagccaccgatttcggatgatgtcttggcaaaggctttccaggtggagaaggggacaattgattggctccaggctcaattctgggagaacaaccactactaaataaatcacatatagcttatcgtatcaaagaatgcttttaaatatgcactttgagtaatacaactacatgatttgagttttcatggtaaaataggccctaaaataagaaggtagaatttcgagtgttttgggtgctattttgtatcgcatgcttcttggtgcaatgacctctaggaagttcgaaataataatctttgttcttgtcgttgggttagatttca

SEQ ID NO: 31 - DNA, 885 bp, Hordeum vulgare
gaggaatggcctcctcttcctctttgtttctcatcgccgtgcttcttgcgctggtctcatggcaggccactgcctatgaccctagccctctccaagacttctgcgtcgccgacatgaagtcacctgtgcgagtaaacggatttccttgcaaggacccaatggccgtcaacacggaagatttcttcaatccagccatgcttgaccagcctagggatactaagaacagcaaggttgggtccaacgtcaccaacattaacgtcatcaacttccctggcctcaacaccctcggaatctcgttggcacgcatcgactatggaccattgggtgtgaacacaccacatatacatccccgtgccaccgagctccttactgtgcttgagggaactctctaccttggatttgtcacatccaacccaaataggcttttctccagggtagtcaagaagggtgacgtatttgtgttcccaaaggcaatgatccacttccaaatgaatctagcgcatgacaagccagcagctgcgttgtcatcactcagcagccaaaaccctggagttatttctatcgccaatgcagtctttggatcaaacccacctatttcggatgatgttttggccacggcatttcaggtggaaaagaaactgattgattggctccaatctcagttctgggaaaataaccactactaatatgttgtagtgtttacacctatcaatagtataaagaataaatgtcatgtatgtttgtgcctgcaagccgccagagttttcatttccttatgaatcgttacaatatatgttgtttgttgggattgatatgataatatggtatggtgtaagtgtttggttgtttaataaatggaatacagttgtatcctcttccctcgta

SEQ ID NO: 32 - DNA, 1280 bp, Zea mays
ctctgctcagctcgaacgaacaaaaaggactcacctcggccctctcctcttgtgcttctgcttccccaccgagtctcctcaaccccaggcactcgccctctgtcccctcccttcctcgcctccgatgccgccgccgccgccgctcctcgagccgcgcgactacctcggcgccggcgccacctcgtcgtgctgctcgtcgtgctgctcctccggccgcgagggcgcggggccccacctcgcgctgcggctcgggcttccggggtccgacgactcccccggccgcggcgcggacacggagcacgcccgcgcccacgtcgacgccgcgctcaccctcggccccggccccggccccgcgcctcccaggggcagcgccaagcgcgggttcgccgactccctcgaccggtccgcgaagctggacggcgttgccgcggatgacgctgctgggggcgtcacgcgggtagctggagctgctgccggagctccgcccgctgccaaggcacaagttgttggatggccgcctgttaggagctaccggaagaataccctagctgccagtgccacaaagacaaatgggggagatgaaggtaggagtgaggcgggatgctgttatgtcaaggtcagcatggatggagccccatacctaaggaaggtggacctcaagaccctattcaagctatgaggatctctcgcttggtctggagaaaatgttcagttgcttcatccctggtcaaaacagttcatgcaagacttcaagaagggataggcttactgatggttttagggttgatgcccttcaggaccaagaatatgtccttacttacgaagataaagatgctgactggatgctcgttggtgatctgccctgggacttgttccccccattttgccggaaacttaggatcatgagaggctttgatgctgctggcatggctcctccaagacccccggaacagacagttcggaacaaatgagggcgggcagcttacttacctggcgctgaactgaagggagagcgacgctgccttggtcaggccttctttcacttgtgcagtgggatttgcgtcctgctgtttcggacgcccattttgcccccgagctggtcgtcacgtgctgtcgctttttgtttgggaaagatagcgtactgcttgctgtatgatactttcatctgtgttcggaagtttgtagcgcttcatatcctggaagggagtaaagaaaatgtccatgctgtccggtgagaatttctttccccgtgctgtgtctgccagtcaaactaactattg

SEQ ID NO: 33 - DNA, 1228 bp, Hordeum vulgare
cacgcacaactgcagttagcaagcaacgagcacgggccgtcctcccgcacgcacgcacagagccaggagacctcaaacccgcctcctcggccaccctctcaaaagccaagatctcccggcgcgcggcgcagtaatgctcgcctgattgcgctggtcatggcgccgacacaggagcgggactacatcgggctgtcgccggccgcggcggcggcggccacggagctccgcctggggctcccgggaacggaggatgccgctggggacggcggcggggcggcgtcgggggcgccgctgacgctggagcttctgtccaagggcggggcgaaacgcgggttcgcgggcgcggtggcggaggaggaggacgagaagaagaaggcgcagccaccggccgccaaggcacaggtggtaggatggccaccaatccgcagttacaggaagaacaccatggcgacgaacttctctgctccgagaagcaaagacgaggccgaggcgaagcaggcgccagcaccaggctgcctttatgtcaaggttagcatggatggtgctccatacctcaggaaggtggatcttaagatgtataagaactacaaagacctctcgctggagctggagaaaaagttcagcggctttactgttggtcatggtgaatcgactgaaaaatcaggaagagacggactatctgattgccgactgatggatcttaaaagcgggactgaacttgtcctcacttatgaggataaggatggtgattggatgttggttggagatgttccatggcggatgttcacagacagctgcaggaggatgaggatcatgaaggggtcagatgcagtgggccttgctccgagggccaccgagaagagcaagaacgagaagtagcaaaaacgacgaacccgatctgtttcctgcggtcgcatcgtacaagggtgatggaccttatgtgtgagaaagggatttatatataacctacgtgtattctctttattatttccttctatctatctgtgttcgttcggaacaagcatgttagatcgtgtaagttgatgtgtgtgtgtatctactacactactttactttgattcggtcgcgtgtgttgtatgtagtttccgctgtaaatcggtgtgctatgcttgtacctcaaactcgtgctttctggagttcgggctgtctgcttgcatccatctgtgtgtttggcgagccatgagaacaacgttgctttcaccctgtg

SEQ ID NO: 34 - DNA, 1416 bp, Oryza sativa
ccccccgcctcgtcgacttccatccatcccactctcgcacttctcgcatcgcaaagctcggcagcaaaagcaaagcaaagccaagccaagcttgaagctccccgcactgagccaagaagcctccacctcaatccgaaagagatctcgtgcgcgcacggcgatgcggtgaatcgggcatggcgccgccacaggagcgggactacatcgggctgtcgccggcggcggcggcggcgctggcaacggagctgcgccttgggctgccggggactgcggaggaggctgagtcggagggcggcggaggaggagggacggatgcggctccgctgacgctcgagctgctgcccaagggcggggccaagcgcgggttcgcggacgccatcgttgggggtcccgccggccagcggcgggaggcggccgggggcaaggcggcggcggcggcggcggaggccgaggaggaggaggagaagaagaaggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggacctgagcaaaagatgaacccaatatgaatatccgacccctacaatcacatcacttttacttgtaaggtcccattctctaaaccacaagggtaatggtctaagttgcgagaaggggattacttatacctatgtgtcaccctcttttttttttgtttttatttgtaccaattatgttagattttaagcgtaagttgtgtaagttcctgtaagttgtctacttaaccttgcttgtagtttcttctgtaaattgttgtgctgtatgatgcaaactatttttggtattttacttggtgcttgcaagttgcaattgtccgtgcaagtcttgtgtctagtttgtaagaaacttccattccttctgatgatctatgaactttgcccctctccggtgctcgaagggccagattactgttccttcagggcagttaggagctgatcattctcatc

SEQ ID NO: 35 - DNA, 1752 bp, Solanum lycopersicum
agcaaataagcttttgttactgtctgccaaatggagggtccttagtttttttttcctctctctctctttctgctaccaaaaaaatagcctcactactccaccatcatcttcttcttccttcttccttcttctcttactgctgctaataagctttttcttacttgggttttctcttccaacatcaaatttacaacttcggttcccacaggattattagagtgatctgtaattgtgatgtctccgccgctccttggtgttggggaggaggagggccagagtaatgtaactctactggcttcttcaacttccttaggaagcatatgcataaaaggatcagctcttaaagagcgaaactatatgggtctatctgattgttcgtcggtggacagctgtaatatttccacctcatcagaggacaataatgggtgtggattaaatctcaaggcaacggagctcaggctcggtctacctggatctcagtctcccgaaagaggtgaggagacttgccctgtgatttcgacaaaggttgatgagaagctgctcttccccttgcacccttccaaagatactgctttctcggtatcgcagaaaacagtagttagtggcaacaaacgaggattttcagacgctatggatggattctcagaggggaagtttctgtcgaattccggtgtgaaagcaggtgatacaaaggagacctcacgtgtgcaaccacctaaaatgaaagatgctaatactcagagtacagttccagagaggccttctgctgtgaatgatgcctcaaaccgtgcgggcagtggtgcccctgctacaaaggcacaggttgttggttggccacccattcgatcttttagaaagaacactctagcctctgcctcgaagaataacgaagaggttgacggaaaagctggctcaccagctctttttattaaggtcagcatggatggtgctccctatttgaggaaagtggacctcagaacctgttctgcataccaggagctatcttctgctcttgaaaaaatgttcagctgttttacaataggtcaatatggatctcatggagctcctgggaaggatatgttaagtgagagcaaattgaaggatttgcttcatggatctgagtatgtcctcacttacgaagataaggatggggactggatgcttgtcggtgatgtcccctgggagatgtttatcgatacttgcaaaaggttgaggatcatgaaaggttcagatgccattggcctggccccaagggctatggaaaagtgtcggagcagaaattagcctatctacacatgattaaagctatccatccagcatttctagtaggcgaggaagacacaaaaacgggtgaagagctcataaacttgaatcctttttaaaggcatgaacagtagctggttgttggtcttggatagctcagcatgggtagatgctttacctgattacgacatggtgttcttttatatttgcgtaatatatgtcctcttttaagtttttttttatcatgtctatttaaaaaaccgtttgatattggagtttgtctgcaaactaatgtgtgttgtgtactgagagctcttctagaggtaatttagtaatgttctaagtgtatttgcttgtttaagttcccttaagtgtgtactttagacccaacgtttgtcgtttgattaagtatgcgtgtgcacttcagaaattgttattactgtatgaataaatgtgtcctccacatttttcatcgggttgtagttatcg

SEQ ID NO: 36 - DNA, 1555 bp, Glycine max 1
aattcggcaccagactttctgtctctctctctctctgcttcactttctcacttttgcattttcttgtgaaaaaaaaaatcctcagaaccaaaatcggttttcttctgtctctgatctctcaaagcttcaaattctccttgtttggtttgtttgtgtgtttggagtatgatgtcgccgccggcggtggtaacggaggaggaggggcggagcaacgtgtcgtcgaccgtggcgtccggttcttcgcaatccttggaccgtttctctcagaatggggctggattgaaagaacgaaattacttagggttatctgattgctcatcagttgatagcagtgcctctactgtgccaagcttgtgtgatgagaaaaaggagaacatgaatttgaaggctacagagttgaggctgggtcttcccggatcccaatcgcctgaaagggagccggatcttttctctttaagcccagcaaagcttgatgagaagccactgttccctttgcttcctactaaagacgggatttgcttgtcggcgcaaaaaactgttgtttctggcaacaaaagaggttttgctgataccatggatgggttttctcaggggaagttcgctggtaatacagggatgaacgcaatgctatcacctaggccttctggagctcagccttctgctatgaaagaaataccaagcaagttgcaagaaaggccctgttcaactaagaatggaaccggtcataaccatacaggtgcttccatcagtggcagcgcaccggcttctaaggcacaggttgttggttggcctcctataagatcatttaggaaaaactcaatggctaccaccactaacaagaacaatgatgaagtcgatggaaaaccaggtgttggcgcactctttgtgaaggtcagcatggatggtgctccgtatcttaggaaggtagatctaagaagttatacaacatatcaggaactatcttctgcccttgagaagatgttcctaagctgttttaccctaggtcagtgtggttcccatggagctccaggaagagaaatgttgagtgagagcaagctgagggatcttctgcatggttctgagtatgttctcacttatgaagataaagatggagattggatgcttgtaggggatgtaccatgggaaatgttcattgacacttgcaaaaggctgaaaattatgaagggttctgatgccattggtttagctcccagggccatggaaaagtccaaaagcaggagttaggctatcctggactgcttgttgtctgatcaaagttttattgttggatccggagagggaaaatcaaaggatgatgatatgactgaattccctggcattggtggtttatcgccctctgctgttatttgtttttatggcccttaagagtttctcgtggtattatgttaatttgttaccactataatatcatatgaagctacattggaaggttagtgtttgtggagtctgtaatcattgtaggaatctgtttgttttggacaaattgaacatctgttacagccaacatacggttctaacactatatttgtgattt

SEQ ID NO: 37 - DNA, 881 bp, Zea mays
gaattccattgtgttgggccacagctaaagccttgtgcaaaattatcattaagctgtcatcaatcatcatggctgccattacggcaggtctgctggtactcctcgctgctgccgtcgccgctccggcgcacgccacggactacacggtcggcgactcgtccgggtggagcagcggcgtggactacgccacctgggcgagcggcaagaccttcgctgctggggacaacctagtgttccagtacagcgcgatgcacacggtggtggaggtgagctccgcggactacggcgcgtgctcggccagcaactccatccagtcctacagcgaccagaacaccaagatcgcgctcacagcgcccggcacgcgctacttcatctgcggcaccccgggccactgcggcaacggcatgaagctcgccgtcacggtcgccgctgggaccgccaccaccaccccggcgtcatccccgcccgccgctgactcgcctccagagacagccacgccgtccgggtctacgcccacggcaacgacgtcgccgtcggcgcccacgacgaagcccacctcgagcagcactggcgctgcctgcggtggggaggcccggctcgctatgggcgttttggcctgggccgcgggcctcgccgggctcgccctgatgggttaggcaagaggcagtgctgtttccgttccatgcttttcctgttgcaggcttttgtggcccgttgtgtttaatctgaattcacgtctatggtctatgctcgattctggcttgttcgagactcccgctgtatacatgtacggctatccttgaatccttcatgctggacctgtcccagcggtctgcaatatgtcatagataacgatatgctatggctatttaatcgttcta

SEQ ID NO: 38 - DNA, 728 bp, Hordeum vulgare
  misc_feature (14)..(14): n is a, c, g, or t
  misc_feature (16)..(16): n is a, c, g, or t
  misc_feature (36)..(36): n is a, c, g, or t
gccacagcaaagtntncaacaattcaaagtctccangaccttcacttgctatcatggctgggcgtgggcttttagctgcaggtttggttctccttgccgccgtcgctccggcctacgccgcggactacaccgtcggcgactcctcgggctgggctagcggcgtggactacagtacctgggcaagcgacaaaaccttcatcgtcggtgacacactcgtgttccagtacggggcgtcgcacaacgtagcggaggtggggtcgtcggactacagcgcctgctccgccaccaactccatccagtcgtacagcgaccaggacaccaagatcacgctcaccaagcccggcacgcgctacttcatctgcggggtcagcggccactgcgccggcggcatgaagctcgccgtcaaggtcgcccccgcggccgccaccacgcccaccccggccacctcgccctccacgccttcggagacgccctccacgtccacaaccccggccgggacgacaactgcgccttcctcgtccaaatcagcggagagcgtcggcggggccagcggtatcgaggcccgctccgtgatgggctctctagttggggcagcgggcattgtcggcctcgccttgatggggctaggcaagaggcaagtgcttttgtttccgttctccgaatatttcagtagtccacgttttcttcttcccgccgagttgcacactgtctgctgtagctcctcttta

SEQ ID NO: 39 - DNA, 870 bp, Oryza sativa
gcacgagggccaccagtactagtacggctctaatcagttcgcgtttgctaattaactctgccatcatggctggagtacatggacttgcagctgcaggtctggtggtgctactcctcgccgccgttgcggccggctttcgccgtggactacaccgtcggcgacacatccggctggagcagtggcgtggactacgatacctgggcgaagagcaaaaccttcagcgttggtgactcgctcgtgttccagtacagcatgatgcacacggtggcggaggtgagctcggctgactacagcgcgtgtccgccagcaactcgatccagtcctacagcgaccagaacaccaagatcgcgctcaccaagcccggcacccgctacttcatctgcggcaccagcggccactgctccggcggcatgaagctcgccgtcacggtctccgcggcggccgccaccacccccaccccgacggcgtcgtcgtccccgccgtccaccgcgacgcccgccacgccgtcatcggaccccggcatggacacgccctcgtcgacgccggacgcgaccacgacgccgacgacgacgacgacgaagtcgacgggcagcaccggcggggccagcggcagcgaggcccgttcggtgatgggcctgctggtcggggccgtcggcctcgccatgatgggctaggctaggcaagaggcagtgctgctcatcttcatccagttcggctattatttctccgcgacgtttaatttttccttattagtttacgcgctccgtgaactcgtctttgtattgtactactacgaccgcgatttcgtattggaactttgattactccctttgcaaaaatactccgtaatattagcactatttgatggtg

SEQ ID NO: 40 - DNA, 948 bp, Glycine max
agggtctcttccattcacaaccttaaacctttctttcttgtaaactttattgattgattctgagaatagaactaagagggtatagacatggctagcgcaattgcagcttcttttttggttctgcttctggctttccccactgtatttggagctgaccatgaagttggtgacactagtggatgggccctcggagttaattacaacacctgggcctctgggaaaactttcacagttggtgacactttggtgttcaagtatgactccactcatcaagttgatgaggttgatgagagtggatacaacagctgcagctcaagcaacagcatcaagaactaccaagatggaaactccaagattgaattgacttcaccaggcaaaaggtacttcttgtgccccatttcaggccactgtgctggaggcatgaagctgcaaattaatgtggctgctgctagtgggacccccccaacaaccccaagtggcaccccaccaaccaccccatcaaacccttctccttctcctccctctgagtcaggatccaccaacaccacttcaccaccaaagcctagtggagctgtaactgtttccagtggcattggccttttggtggggtctttctttgtgtcagcaattatgtttggtttcatgggctagggaagaggcagtgctgttttttttttattctcctttttattaatatgttattgttttgctgagagtttgtgtgaatttcatcatttaatccagatgtatatctaatcttgatatgtatctccttttaatatttaaaaatgacacatttctttagctgcttccccccctattcttttgatagctgggatgatggtgacattatatatatctaatatcccttgctttattttgttatcttttggctggaaataattgtacctgaaacaattgtagtccacttaaatagtggtctttttg

SEQ ID NO: 41 - DNA, 611 bp, Solanum lycopersicum
tatggccggggactcaaaattaagaataccaaactctcttatcttttaaattcatcaaaaaaaatgggaaaacttttggctgtgacttttttgttcatgtgttgtgttgttccaagtttggccaaagtttatactgttggagactcatctggatggggacttggtgtggattataccacttgggctagtggaatcactcttaatgttggtgattcacttgttttcaactatccaagtggtcacacggtagatgaagtaagttctagtgactactcttcatgcactaccggtaattccataacgtccgacagtagcggcgccaccactatccctctcaagaccgccggcactcattacttcatttgcggcgtaatgggccactgcagcggcggcatgaagctagccgtcaccgtggcagcagccggaggaagtggtggtgctaccacaccatcaaccggcaccaccacaccaacaaccgggaccaccgctcctaagactgaaactactaatactacacatccatctgcatcagttactttgtcaccatttattcccttgttaatttccggtgtggttgcaatatttagttattttgtcactatttaataagc

SEQ ID NO: 42 - DNA, 1193 bp, Zea mays
cttccggccttccccttttcytccggtcgacgcgagggagcgggaggttggcctctaggcagggtggcgggcgaagatgttggacatacagaagcggcgcgtgcggctgctgctcttcatcacggccgtcctcgcgctcagcatcaccgctgagaagttcagggaacttgttggaaaggaggctgcatcaaagagtggtcaattcacattcatgaactgctttgacatgggctctggcagccttgcgtgcactgcaaaggagggtgtcaagttgtacgtcaacaacatccgaagtgcacacttggaaatggtgcggcaacgagccatggagaaagctttagctgatgctgtgacggaaggcctaacacctagtgaagcagccaaacaagctcagaagattagtgcaaaagcgactaaacttgctgctcgtcaagccaaaaggatattgggaccaataatttcttgtggttgggacttcttcgaagcaatgtactttggtggaagcatgacggaaggttttctccggggcactggcaccttgtttggaacttatatgggtggtttccatggtgaggagcgctttgggaagctgggatatcttgcaggaagccatctaggaagctggggtggaggaagaattggattgatgatttatgatatcataagcggcctgaaatttatgttccagtctatccaacctgagtatgaatcatcttcatatgctgaagatggtccagaatacgcagaaagttacacaaaccaagaggactcaacatactatgaaacatcagaggaaaagcaggaagaatcaaaatggtttggtttgttctgaaactgcgaaccgaattgttctgtcttgtacttaggggcgaagctaggtagtagctggagtgttgcaccccctgaaaatgtgaaaacagtgctttccactgaaatttcaccatatatgtatccacaaggcaagtgtactcactaatttgctctagcttcgccacagttatactggagcaggggaacagttagctgttttattatacctttctgaatgtttagcttcttttgcgtcataggtaggtatgattcttctctgtaattcttgttttggctactgtgtacataaaacatatggatcaactctggagattgggcaggcagaatgcaccataaataacagcaacagtgaacacttacgg

SEQ ID NO: 43 - DNA, 1086 bp, Hordeum vulgare
cggcacgagggagagatccttggtctgcagcgcgcccgagctgagcgtaggcaggcgggcgaagatgctcgacatccagaagcggcgcgtccagcttctgctcttcgtcaccggcgtgctcgccctcagcatgacagctgagaagtgcagggaacttgtcggaaaggaggctgcatcaaagagtgggcagttcacattcatgaactgtttcgatatgggatcgggcagccttgcatgtgcagggaaggagggggtgaagctgtatgtgaacaacatccgaagtgcacacatggaaagggtgcggcagcgagcccttgagaaagcgttggctgatgctttgacagaaggcctgagtcctgctgaggcagccaagcaagctcagaaggtcggggcgaaagcgacgaaggtggccgctcgtcaagcgaagaggatattggggccgataatttcctctggctgggacttcttcgaggcaatgtatttcggtggaagcatgactgaaggttttctccggggcacgggcaccttattcggaacctatgcgggcggtttccatggtgaggagaggctgggaaagcttggctatcttgctggaagccagctaggcagctgggtcgggggaagaatcggactgatggtctacgatgtcatcaacgggttgaactatatgcttgagtttgtccgtccagaggagtaccggcgatcatcatcatcatctcattatgcatcagaagagggttcagagtatttagatgactacagaagcggcgaaggatatgagccaacattcagtgagacgctagaagaggcgcaggaggaggaggaatcgcggggtttcagcttgttctgaaacctgaagcttggatatcaggcgacttacactgggatggcagcaggccaagaagcaagcaccacctatactgaacttgtttttgcatttctagatgagggagtgattcttgtctgtaattcttgtatggcgattgtgtataatagaaacgtttgcgtgcaaccatggctgtggctgcatggtctatacagcagaggtactgagcatcatcaacaaagaagaatcacatttggtct

SEQ ID NO: 44 - DNA, 796 bp, Sorghum bicolor
gcacgaggctcccttccctgttcctcggtggacgcgagggagcgggaggttggtccgtaggcagggttagatcctcgcggcgctcgattccgacggtggcgggcgaagatgttggacatacagaagcggcgcgtgcggctgctgctcctcatcacgggcgtcgttgcgctcagcatgaccgctgagaagttcagggaacttgttggaaaggaggctgcatcaaagagtggtcaattcacattcatgaactgctttgacatgggctctggcagccttgcatgcacagcaaaggagggtgtcaagttgtacgtcaacaacatccgaagtgcacacttggaaatggtgcggcagcgagccatggagaaagctttagccgatgctgtgacacaaggcctaacacctggtgaagcagccaaacaagctcagaaggttagtgcaaaagcaacaaaagttgctgctcgtcaagccaataggatattggggccaataatttcttgtggttgggacttcttcgaagcaatgtactttggcggaagcatgacagaaggttttctccggggcactggcaccttgtttggaacttatgtgggtggtttccatggtgaggagcggtttgggaagctcggatatcttgcaggaagccaaatagggagctggggtggaggaagaattggattgatgatttatacaaaccgagaggagtcaacatactatgaaacatcagaggaaaagcaggaagaatcaaaatggtttggtttgttctgaaactgctaactgaagtgttctgtctcatact

SEQ ID NO: 45 - DNA, 798 bp, Oryza sativa
atttattctttcttttttcccttcctccctcctcctcctcctcctccggtggatgcgatccgcgagggcaatcgatctccgcagcgtctgaggcaaggggcgtaggaggagggcgaagatgctggacatccagaagcgacgcgtccagctgctgctgttcatcgtgggcgtcctcgcgctcagcatgaccgctgagaagttcagggaacttgtcgggaaggaggaagcatcaaagagtggacagtttacgttcatgaactgttttgatatgggctcaggcagccttgcgtgcgcagtgaaggagggcatcaagttgtatgtctacaacctccaaactgcacatacggaaagggtgaggcaccgggccattgagaaagcattggctgatgctgtgacagaaggcctgtctgccgctgaggcagcaaagcaagctcagaaggttggtgcgaaagccgcaaaagtggcagctcgtcaagccaagaggatattggggccgataatttcttctggttgggacttctttgaagccatgtacttcggtggaagcatgactgaaggttttctccgaggtaccggcaccctatttggaacctatgtaggtgggttccatggtgaggagaggctggggaggtttggttatcttacaggaagccatctgggcagttgggttggtggaagaattggattgatgatttacgatgtcataaatggcttgaagtatatgcttcagtttgtcaagccagagtatgaagcatcagcatattattcataagagagtacagagtatgcatatagtta

SEQ ID NO: 46 - DNA, 991 bp, Glycine max 1
ggtagcatgtgctgtcaaggaaggtgtgaagctctatttttacaatattaggtcttctcatgctgaaagagcgaggagtcaagcaattgagtctgccctcgttgatgctgttactcaggggatgtccccaacagattcagcaaaacatgcacagaaagaaggtaagaaggcagcaaaattggcttcccgtcaagccaagcggattataggtcccatcatttcctctggatgggactttttcgaagctatttactatggtggtactgtcacagaagggttccttagaggcactggtactttgtttggtacttatgctggagggttccttggggagcaaaggcttggtagaattggctatcttcttggaagtcacctgggcagttgggttggtggtagaataggattaatggttcatgatgtggccaatggagtgcatttgttgttgcaatttgttcagacaggagaaattgaagttcatgaaaaatccaaacgatctgaaagttcctccttttttggggaaactcctgtttatgacagctctgaaggctctggtgtttatgagtcacctcccagtgaagaatcctatgcctatgaatctactgaacgtcagagctatgaaacatatgaagattctgaactgtgatgaaaatttgcagttcatatattgataaaatttcaggctgctccgagggcctttagtgttgacaaaatcatctctcagcaaagaaagaatccaatgcctattctactgaacctcagagccatgaaacattaaaagattctgaacagatgaaatttttaagttcatatattggtacttgctcaaactttaggtcgattattggtgtttttctttaatgtctttgcttcaatataacagggattgctaacccctggagactttataagtgctccacctcttgtaattggcgaatgtagaaggtcccaccaattattctattgttcaatgtatctgttgccttcagccttc

SEQ ID NO: 47 - DNA, 901 bp, Glycine max 2
agaagaagagggttcagtttctagcctttgtcgctgccatcattgctcttagcattacagctgaaaaatgcaggcagctagttggcgagaaggcatcatcccagagtggaaagtttacattcctaaattgctttgacatgagttctggaacattagcatgtagtgtgaaggaaagtgtgaagctctacttctacaatattagagctgctcatgttgaaggagcaaggcatgatgcattgcagtctgcccttgttgatgctttgaagcagggaatgtcacaaagtgcttcagcaaaatatgctaagaaagaaggtgacaaggcagcaaaattggcttcccgtaaagccaggcgcattataggtcccatcatctcttcagggtgggatttttttgaagctgtttactatggtggtactctcactgaagggttcctcaggggaagtggcactttgtttggtacttatgctggaggcttccttggggagcaaaggcttgggagatttggttaccttgttgggagtcacttgggtagttggattggaggtagaatagggctaatgctctatgatgtggctaatggagtgcatttcttgttgcattctgttcaatcacttggaagtgatccaagttcaagaaacttaggctaaccatcaagaaaattaattctgaagcaactacaagttcctttttacatgacacttctgtttatgttcagttctagaggttatgttcataaattttgaatttactatctagcagagctacgacacaaaagaagattctcaattgagtatatgtaagtggtaagtttactcaattgagatatttgtcattttcttacatttaattggatgtatatgtaattttacaagtgtttataaattggtttttctttaacgtt

SEQ ID NO: 48 - DNA, 978 bp, Solanum lycopersicum
  misc_feature (918)..(918): n is a, c, g, or t
atagattctcaactgctgcatatccatcttcttagattcgcttttgatacttagggtttgtgtgtagtcatttttgagttcaatgattgagaagaagagggttcaagttcttctctttctcgttggcctactaattctcagcatcaccgctgaaaaatgtagggagttggttggtcaagaggctgcatcgaagagtggggaatttacttggttgcaatgttttgatgggggtacgggaagcgtagcatgtttagtcaaggaaggtgtgaagctgtatgcttataacatcagatcctctcatgtggagatagcaaggaactccgctattgagatcgctctggctgatgccatatcacaaggcatctcagcaaaagaagcagctaaagtagctcagaaagaaagagcaaaagctgcaaaattggccgttcgaaaaacgaagcgtattgttggtccgataatttctgcaggatgggacttttttgaagcactttatcttggaggtacaccgactgaaggggcattgaggggttctggtaccttgtttggcgcctattgggttggttatctcggggagcagaccatgggtaggtttggttacttggttggaagtgagttgggcagttgggttggaggaaaggttggattaatggtgtatgatttagttaatggcgtggatcatttacttgcatttctccaactaaaggaaatagaagtggatagaactgtgtatgatgaattgtacaaggaaactagttccgaggtacccaaggagtcgtatgatagtgaatcaagtacatattcaagctttgaagctccagaagagtctagtagttatgaagctccagaagagtctagtagttatgaagctcctgcttatgaggaccctgaagtccatgaagaattttaagactggatggntcttttgatattattagatatcacatcatgtgtgtcctctgctcaatcacaacttgtaca

SEQ ID NO: 49 - DNA, 2149 bp, Zea mays
aattcgcggccgccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcggggcactggcggatgctggtgggcagcgtgcgcggcgcgcgcgggatggcgctggtgtaccggagccgggacttcaggaagtggaccaaggccaagcacccgctgcactcggcggcgctgacggggatgtgggagtgccccgacttcttcccggtgtccgggccggggctgcaggccggcctcgacacctccgcgcccggaacaaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtgttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaaaaaacaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatatacaacaatatgacacgatgaataaaaaaagcggccgcg

SEQ ID NO: 50 - DNA, 2057 bp, Zea mays
tacaaataacaccgatcagtacttggttctcttctcctgtgctccacattataatactgtttgatcagtcctaattggtttcagaaaagctatctcgtactagtgagttagggacgacgatgggcatggcggcgctgttgcttgtgtgggctctgctgcactgcgcaggcacggtgacgatggtgcgggcgtcccacgccgtgtatccggagctccagtcactggaggcggagaaggttgatgagacgtcgcgcaccgggtaccatttccagcctccaaagcactggatcaacgatccaaatggaccaatgtactacaaggggctgtaccacctgttctaccagtacaaccccaagggcgcggtgtggggcaacatcgtgtgggcgcactcggtgtcgaccgacctgatcgactggacggcgctggccccggggatctacccgtcgaggcagttcgacgtgaagggctgctggtcgggctccgcgacggtgctgccgagcggagtgccggtggtgatgtacacgggcatcgacccggacgagcaccaggtgcagaacgtggcgtaccccaagaacctgtcggacccgttcctccgcgagtgggtgaagcccgactacaaccccatcatcgcccccgacagcggcgtgaacgccagcgccttccgcgacccgaccaccgcctggtacgggcccgaccgccactggcgcctgctggtgggcagcaaggtgggcggcaagggcctggccgtgctgtaccggagccgggacttcaggcgctgggtcaaggcgcaccacccgctccactccggcctcacggggatgtgggagtgcccggacttcttccccgtcgcggtgcacggcggcggccgccactaccgccgcggcgtcgacaccgccgagctgcacgacagggccctggccgaggaggtcaagtacgtgctcaaggtcagcctggacctcacgcgctacgagtactacacggtgggcacctacgaccacgccacggaccgctacacccccgacgccggcttccgcgacaacgactacggcctgcgctacgactacggagacttctacgcgtccaagtccttctacgatccggccaagcgccgccgcgtgctgtggggctgggccaacgagtcggacaccgttcctgatgaccgcaggaagggctgggccgggattcaggcgataccgaggaagctgtggctgtcgccgcgcgggaagcagctgatccagtggccggtggaggaggtcaaggctctgcgcgccaagcacgtgaacgtcagtgacaaggtcgtcaagagcgggcagtacttcgaggtcaccggcttcaagtcctccgacgtggaggtggagttcgcgatcggcgacctaagcaaggcggagcggttcaaccccaggtggctgaccgacccgcaggcgctgtgcaagaagcggggcgcccgggagacgggcgaggtggggccgttcgggctgtgggtgctggccgctggcgacctcacggagaggacggccgtcttcttcagggtgttccgggccaacagcagcagcagcagcaggctcgtcgtcctcatgtgcaacgaccctactaactccaccttcgaggcgcaggtctacaggcccaccttcgccagcttcgtcaacgtcgacatcgccagaaccaagacgatcgcgctgaggacactgatcgaaccctccgtggtggagagcttcggcgcgggcggcaggacgtgcatcctgacgagggtgtaccccaagaaggccctgggcgacaacgcgcacctcttcgtcttcaaccacggcgaggtggacgtcaaggtcaccaggctggacgcctgggagatgaggaccccgaagatgaacgtgccggcgcagtagctagtggtggtagtggtagctcgatctagggaaatggtctagttttgttagagaagcggttctggctcgttttcgctcacgtcgcctctcagattgttctcgatctcatccatcactacattgcaacgaattctaccactctctcggcgcctcccactggtttagcaatgaataaaa

SEQ ID NO: 51 - DNA, 1709 bp, Zea mays
  misc_feature (658)..(658): n is a, c, g, or t
cggcccgggctgccatcaacgccagatcctagcccgccattaatgccgttaacccgagctcgagatcggaggcggcggccccgtgttcgcgccaggagtggccaccgtacgtgtgacacgcgccgccgccgtttataaaagcacaccgccgctcgctcgctcgcccgcccgcccgccaccactcactcggctcgggttctgctctgcacctcagtacctcacactgtcaccgcgcttctgtgacctgacgaccttcggcggcaggatgctcacgtgcatcgcgtgctccaagcagcagttcgccggcggcggcccgccgctgcacgaaccgccggaggacgacgatgtagttgacggaggaggcggcggcacggcgacgcccagaacacggcacgccatcaaggcgctgactgcccagatcaaggacatggccctcaaagcgtcgggcgcgtacaggcactgcaagccctgcgcaggctcctcggcggcggcctcgcggcggcaccacccgtaccaccaccgcggcggcagcgccttcgggggctccgacgccggctcggcctccgaccgcttccactacgcgtaccgtcgcgcgggcagctcggcggacgccacgacgtccatgagcgtgcgcacggacttccctgccggcgacggngaggacgacgaggtggcgtcagaagccgctggcggatgcggtggcaaggacgacgacgccaaggagtgggtggcgcaggtggagccccgcgtgctcattaccttcgtctcactggcgcaaggtggcaacgatctaaaacgcattcgattcagccgtgagatgttcaacaaatgggaagcacaaagatggtgggctgaaaactatgacaaagttatggaactttacaatgtgcagaagtttaatcaaactgtccctctcccagctaccccaaaatctgaagatgagagctccaaggaggacagcccggtgacaccaccactggacaaggaaaggctaccccgcactttccacagacaaggtggtggagcgatgggctcctcttcatcagattctctcgagcatcactcaaaccactactgtactggccgccaccaccaccaccaccaccatggacaccaatgctgtgattcaatgggcctggcatcaacgccaaagctgtcaagtatcagtggagccaaaacagaaacctcatcgatggacgcgtcaatgaggacaagctcgtcaccctgaggagatcgacaggtctggtgagctctcggtgtccgtcagcaatgcgagcgaccaggagagggagtgggtcgaagaagacgagccaggcgtatatatcacaatccgggctttacctggtgggatcagagagcttcgccgcgttcggttcagccgggagaagttcagcgagatgcatgccaggctgtggtgggaagagaaccgagcgaggatacacgaacaatacctctgagaagagacgcccgacaccatcagcagcacgagcacatgaatagagctggcactaacacatccacatgcatttccagcttcatacgatgttttgctaacctaagaggtccggtttccggtattttacatttcgttcagtctcacgtgtggtggtggtggggtgggaggatagtgtacgtatttcacagtttcactactgaatctgtaggtctcgtttttcatcaataatgtatatctacctgttgtttcccat

SEQ ID NO: 52 - DNA, 1417 bp, Triticum aestivum
gcacgaggctgaattgacgggggattttcttgggttcagatcaaggacatggcgctcaaggcgtcgggcgcgtaccggcactgcaagccttgcgccggctcctccgcggggggctcggggcggcaccacccgtaccaccaccgcggcggcagcggcttccggggctccgacgcctccgaccgcttccactacgcctaccggcgcgccgcgggcggcggctccagcggggaggccacgccatccatgagcgcgcgcaccgacttccccgccggcgacgaggaggaagaagaggaggaggacgggatgtcatctggcggcggcggcggcaaggaggacaacgccaaggagtgggtggcgcaggtggagcccggcgtcctcatcaccttcgtctcgctgccgcaaggtggcaacgacctcaaacgcatccgattcagccgtgagatgttcaacaaatggcaagcgcaaagatggtgggctgaaaactatgacaaagttatggaactttacaacgtgcagaggtttaaccatcaaagtgttcctctccctactactccaaagtctgaagatgagagctccaaggaggacagcccggtaacaccaccactggacaaggagcgagtacctcgttctttacagagaccaacatcgggaggcggagcgatgggttactcttcatctgattctcttgagcaccattctaaccactactgtaacggtctccaccctcaccatgggcaccagtgctatgattcagtgggactggcatcgacaccgaagctgtcaagtataagtggggccaagacagaaacgtcatcgatggatgcgtcaatgaggacgagttcatctccagaagaggtcgacaggtccggtgagctctcagtgtccatcagcaacgcgagcgaccaagagagggaatgggttgaggaagaccagcctggtgtatatattaccatccgggctttgcctggtggcatcagagaactccgccgtgttcgattcagccgagagaagttcagcgagatgcatgcgaggctatggtgggaggagaatcgagcgaggatacatgaacagtacctctgagacaggagaagaagcacagatgaaaacaataccgaggactttgccgttgacatgagccagccgtggatccatgttgtacatttgcagtttgagctaacattactccctctctgggcagcgtgtgtgaggtgaaggcgtctacagaaactgaactatactgatctgctaggctctctctgattatgtggccatccacatgttctcctgcatggtttttagctttaaattgcgcaaggaacttcgtttgtgtccggtaactcgaaaagggtgcgtactgtgtcattaggctagagataccatctgttctgaaactgtggcttgccaaaatcaattcccc

SEQ ID NO: 53 - DNA, 1554 bp, Zea mays
  misc_feature (1533)..(1533): n is a, c, g, or t
  misc_feature (1535)..(1535): n is a, c, g, or t
  misc_feature (1538)..(1538): n is a, c, g, or t
agagaaggcactggaaactctgaagcgtcgcagaacgctcctccctctaaggctccgacctccgtgcctcgcgcgccctcgcccttgccctcgccctcccccaccaacccaaaacccgatccgttgctcgctgctcagggtccactactgatccgctccacgcgagctcccttgtccccgcgtcacactcgcgcccaagcaagcggttgctgcaaaggaagcctcccctgatggctctcgtgacctcgggctcgggtgccgaccaggtgatcgccgaggtggcgatgaacggcggcgccgacccaagtgcaaccaccgtgcgtgctactgtcgtgcaggcgtccaccatcttccacgacacgcccgccactcttgataaagcagagagattgatagcagaggctgctgggtatggttcacagttagttgtctttccagaagcttttattggaggctatcctcgtggatccacatttggtttcgggatcagtattagtattattaatccaaaagacaagggaaaggaagcattccggaggtatcatgcatctgctatagatgtgcctggtccagaagttacacgcttggctgctatggctgcaaaatataaggttttcttggtcatgggggtgattgaaagggaaggttacaccctttattgttccgtgcttttctttgaccctcttggccgttacctgggtaagcaccggaagctcatgcctacagcattagagagaattatatggggatttggggatggatcgactattccagtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactatcctcccccaccggagtatgagtttgctggtttaggtgaagagccatccgcggacactgttgtttgccctggaggcagcgttatcatttctccatctggagaagtcttggcaggtcccaactatgaaggagaggcactgattacagccgaccttgacctgggagagattgttcgagccaagtttgatttcgacgtggtgggacactattctcgacctgaagtccttagattggtagtgaacgaccaaccgcagctccctgtgtctttcacgtctgccgctgagaggactccagctgccaagagtgatatcgatactaagtcttactgattgactggtcatgaaactgtgttgcgccgaacacttggtgatggtcgctcagctcctctagtttgctgttgtgtctcgtggatgggagttgggagttgtagctttgaactaaaaaaaaaactcttgccttcccaacgtaaaaaaatggtggccgcagttatgttccttgtgaaagctgttcgcttggctttaatctaaaactgtttctscgccccananccnagcaagacgaatgggt

SEQ ID NO: 54 - DNA, 768 bp, Zea mays
ggtctagaaacaatggggaggggaaagatcgtgatccgcaggatcgataactccacgagccggcaggtgaccttctccaagcgccggaacgggatcttcaagaaagccaaggagctggccatcctctgcgatgcggaggtcggcctcatcatcttctccagcaccggccgcctctacgagtactctagcaccagcatgaaatcagttatagatcggtacggcaaggccaaggaagagcagcaagtcgtcacaaatcccaactcggagcttaagttttggcaaagggaggcagcaagcttgagacaacaactgcacaacttgcaagaaaattatcggcagttgatgggagaggatctttctgggctgaatgttaaagaactgcagtccctagagaatcagttggagacaagcctgcgtggtatccgcacaaagaaggaccatctcttgatagatgagatccacgaattgaatcgaaaggcaagtttatttcaccaagaaaacacagacttgtacaataagatcaacctgattcaccaagaaaatgctgaattacataaaaagatctatgagactgaaggacaaagtggagttaatcgggagccaccaactccattcaactttgcagtagtagaaaccagagatgttcctgtgcaacttggactcagcacactgccccaacagaataacattgagccatcaactgctcctaagctaggattgcaattaagcccatgaataagagtaaaactggcgtcttatgatcccgaa

SEQ ID NO: 55 - DNA, 923 bp, Zea mays
  misc_feature (920)..(920): n is a, c, g, or t
ggtctagaaacaatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcgaagaaggaccatctcttgatagatgagattcatgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttcctgtgcaacttgaactcagcacactgccacagcaaaataatattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgcggaattcagaggatgattgctttctagttgcgatnctg

SEQ ID NO: 56 - DNA, 725 bp, Zea mays
attgtgttgggcgagatcataaactacgtacagtcgctgcagtgccaggtggagttcctgtcgatgaagctgtcgacggtcgatccgcgtcgggacctcgacgtgggctgcttcgtcgtccccagagacgacgtaacgatgcaggccaacaggctgtgcgcgcccgcgacgtcgtcgtcgagctcagccttctgctacgccgcgcggagtgttgttacgaacgccaaaggattcgagacgccggtgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaattattaatggtatttgagtcttatagacatcaagttgatgaaattttatactacgcaagatgctttcggt

SEQ ID NO: 57 - DNA, 1569 bp, Zea mays
gagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaagcaccctaacattattaggtttaaagaggttattttaacaccgacccatcttgctattgtcatggaatatgcctctggcggtgagctttttgagaggatatgtaagaacgtgcgattcagtgaagatgaggctcgctacttcttccagcagcttatttcaggagtaagctactgccattcaatgcaagtatgccaccgtgatttgaagttggagaacacacttctagatgggagtgacgctcctcgcttgaagatttgcgatttcggttattccaagtcatctgttcttcattcccagccgaagtccactgttggaacacctgcttatattgcacctgaagttttgttgaaaaaagaatatgatggcaagattgctgacgtttggtcatgtggtgtaaccctctatgtaatggctgttggtgcatatccttttgaagacccagaagagcctaagaacttccgcaagacaattcagcgcatcttgaacgttcagtacgccattccagactacgtgaacatatctccagagtgcaggcatctaatttcgaggatttttgttggtgatcctgctatgcgaataacaatcactgaaatccggaatcatagttggttcctgaagaaccttcctgctgatcttatggatgatgatagcatgagcaaccaatatgaggagcctgatcagccaatgcagaccatggatcagatcatgcagattttaacagaggccaccataccacctgcctgttctcgcagtataaatgttctagctgatggactggacatggacgacgacatggatgatcttgactccgattcggatcttgatgttgacagcagcggtgagattgtatacgcaatgtgagtaacatctcagtaaccatctcagtatctcaccagtcaaccaaagaaccaatcaggcatgggacaccctgatgttgtacactctgccaaagacctagcatccttttgtaaaatatctccctgtagttttctcaaagaagcgcaagcccaacctgttctggggaacacggatgctgtagtcaaactggggttattcagattgtaaaactggcctcttgcttcctgcttactctcaggcttcgacttgtgtgttgctgttgaatatgtacttacaagaaacttctacggagtactcatgttgatct

SEQ ID NO: 58 - DNA, 857 bp, Zea mays
tggcccaaacccaagcagagaagcagagaccatttggctcactcactcacactcactcgctcatagattgtcctgtccgtccatcatctctagctagcagcttccagtgagagcggcaagcgacaccacaaccagacaacacaccaccaccgagctgtgagaagaagttcgcagacaggatgggcaagctgtggacgatcctcactcacctccactccctagcagggccaacggtgatgctgctgtaccctctgtacgcgtccgtgcgggcgatggagagcccgtccaagctggacgacgagcagtggctcgcctactggatcctctactccttcgtcacgctcatggagatgctcctcgagtccctcatatactggatccccatctggtacgagctcaagctgctgttcatcgcgtggctcgtgctccccaacttcaggggcgccgccttcatctacgacaagttcgtgcgcgagcagctccggaagcacggcctcaccgccgccggctccgtcaagtcgtcgtcgccgtcgtccaaggacaaggacaagcccaagaacaagttcctcgccttcgtcacgcccaagaaggatcatgaagcttactgaagtgggttgcagtgatcccattcctggaccatgtcccggcaacctgtagctgtagtgcactccactagatttctgttgtgtttgttctcgacttgaaatagagcctgtacgatgtgtgtatggccattctgtatgtgtgagcatcaactctaacatggaatggagacaagagccaactttcggtgctgatgatgatgtgaatgtgtgaaatttatgtcattatacagtgttttagacagacatttgttg

SEQ ID NO: 59 - DNA, 874 bp, Hordeum vulgare
ctcgtgccgaattctgcacgagaaatccaatacccaggatacaaactgttctgagtctctgcacatcagtcttcgcccccactgattcgttcgtccagccgagaagaagaagagctgcagaagcagaagagaagatgagcaagctctggaccatcctcacccacctccacaccctcgcagggcctggggtgatgctcctgtatcccttgtatgcgtcggtgcaggcgatggagagcccgtccaagctggacgacgagcagtggctggcctactggatcctctactccttcgtcacgctcgtcgagatggtcctcgagtccctcatctactggataccgatctggtacgagctgaagctgctgttcctggcgtggctggcgctgcccaacttcaggggagcggccttcatctacgacaggttcgtcagggagcagctcaggaagcacggcctcaccaaccaccccggcagcggcatcagcagcaagaaggagaacggcggcagggtcgacaagtcgtcctcgccgtcgacgtctcccaaggagaaggagaacgccaagagcagattcctctccttcgtcgcacccaagaaagatcactgagatgtgagattggagcagcaaccagagcatccctctgcggctagctttgatggcttgtactagtttgtttgagatttttagcttgtggtgttggagtatcttgtccaaaaaaaattgtgctacgactcactccatatatgaggcccatggttgcaggctagctagatggtggcttgtggtgtcctggtgttgtagtacgtattacatatctgtccagaaaaatgtagtactcagaggtttcatctcattctgatctcattcctgcgtcttaatct

SEQ ID NO: 60 - DNA, 841 bp, Triticum aestivum
ccacgcgtccgaaatccaaatccaaacccaaaccaaaaccaagaagacacactgttctctccatcagtctccgcctcaactgattcgtccaaccaagaagaagaagagctacagaagagaagatgagcaagctctggaccatcctcacccacctccacaccctcgcagggcctggcgtgatgctcctgtacccgttgtatgcgtcggtgcaggcgatggagagcccgtcgaagctggacgacgagcagtggctggcctactggatcctctactccttcgtcacgctcgtcgagatggtcctcgagtccctcatctactggataccgatctggtacgagctgaagctactgttcctggcgtggctggcgctgcccaacttcaggggagcggccttcatctacgacaggttcgtcagggagcagctcaggaagcacggcctcaccaaccaccccggcagcggcatcagcagcggcagcaaggaggagaacggcggcaaggtcgacaagtcgtcctcgccgtcgacgtctcccaaggagaaggagaacgccaagagcaggttcctctccttcgtcgctcccaagaaagaccactgaaggagattggagcagcaaccagagatcccagcagctagcttcttggcttgtggtgttttcttggtttgtttgagattttagattgtggtgttgagagtatttacatatcttgtcagaaaaaaattgtactacgactccatatatgaggccctcggttgcaggctagctagatggtgggtggccttgtggtgttgtagtattacatatctgtccaaaaaaatgtagtactgagattggagcagtaacca

SEQ ID NO: 61 - DNA, 833 bp, Saccharum officinarum
catcacccaaacccaagcaagcaaaacacatttggctcactcacagtcactcactcatctgtccgtccatcatctctagctagcttccagtgaaagctgcaagcgacagcacaaccagctgagaagaaggttgtagaagatgggcaagctctggacgatcctcactcacctccactcccttgcagggccaacggtgatgctcctgtaccccttgtacgcgtcggtgcaggcgatggagagcccgtccaagctggacgacgagcagtggctcgcctactggatcctctactccttcatcacgctcatggagatggtcctcgagtccctcatctactggatcccgatttggtacgagctgaagctgctgttcatcgcgtggctggcgctccccaacttcaggggcgccgcgttcatctacgacaagttcgtgcgggagcagctccggaagcacggcctcacctccgccgccgcctccggcaagaaggacgacggcaagtcgtcgtcgccgtcgtccaaggacaaggacaagcccaagaacaagttcctcgctttcgtcacacccaagaaggatcatgaagcttactgaagcagggtgcagtgatcccatccctggaccatgtcccggcaacctgtagtgtattcccctagatttctgttgtttgtttttgttcttctcttgaaatagagttgttcgatgtgtgtatggccatcctctatgtgtgaacatcaacttcaacatggaatggagacgagacgacctttcggtgttgatgatgtgattttttttagataaagtcaatatatgcagtgttctgggacagacttttactctg

SEQ ID NO: 62 - DNA, 923 bp, Oryza sativa
tcgcccttggacactgacatggactgaggagtagaaaaaatcaaagaacacaaagcatccaaaacaacaccaggaaacttcttttcaatcgatcactccactggtgagtagtgagtggctagtgactggtcagttcatcacttgtgaaggttttgcaatcaggaaaagttcagaagatcatgggcaagctctggacaatcctcactcacgttcattcccttgcagggcctaccgtcatgctcctgtaccccttgtatgcgtcggtgcaggccatggagagcccatcgaagcttgacgacgagcagtggctggcctactggatcctctactccttcatcaccctcgtggagatgcttctcgagtccctcatctactggataccgatctggtacgagctgaagctgctgttcatcgcgtggctggcgctgcccaacttcaggggagccgcgttcatctacaacaggttcgtcagggagcagctcaggaagcatggcctcgccggcgccggcgccggcgccgccgccagcgtcggcaagaaggacaagtcgtcgccgtcgtcgtcacccaaggacaaggagaagaccaagagcaagttcctctccttcgtcactcccaagaaggatcatgaagcttactgagccaagaagtgctgatcagtcggatccctgaagatagttttttagtgtgtgtactgttccatttgtgtttgtccctcttcctctccttcagaagaggcagctagctagcttcatgtttggctggtctttttggccatctgtgcatgtctgtaaactttattggagtgaggggaaaaaagagcataattagttgctccatgttgagttgttagagtggtttcttgtaaatgtaattcaggatctcagatgagcagacaataaaaacacactgttccaggagtgccc

SEQ ID NO: 63 - DNA, 709 bp, Glycine max
ccacgcgtccgcgttttctcacttcacacgttcattttcatttcaccttataaggttactagttattgtgaccaaccaccccatgcctaattaagccccactttactctttctatttcttccttttcttttcatcttggttcactctcacacctacaaattaataataatacaaacacatatgggcaagttgtggaccttgatcatccagcttcattctattgctgggccggttgtgacgttattgtaccctttatatgcatcggtggtagcaatagagagtcagtccaagttggatgacgagcagtggctagcttattggatcatctattcgttcctcacccttacggaaatggttcttcaacctatcttagagtggataccaatttggtacgatgtgaaactattgacggtggcatggctggtgttaccccagttcgcaggagctgcgtacttgtatgaaaggttcgtgagagagcatataaggaaatacataacggagaaggagtatctctatgtcaaccaccagcaacaaagcaaaaagtctcccaataacgggggcaaggccaagaagttcgttgaattcgtcacacccaagaaaggggatcaggaggtgtattgagttggcaattggacggtgccgagaagtgtagagttttttaactgaggatcttcgtattggtctttgaatcaactttccttttaatttg

SEQ ID NO: 64 - DNA, 1363 bp, Zea mays
gaattccttgtgttgggcctttcgttcggtgtcgccaactcgccattcttgggaggtcttggtcgggaccggtgctgatggaggagaggtacgaggcgctgaaggagctgggggccggcaacttcggcgtggcgaggctggtcagggacaagcggaccaaggagctggtagccgtcaagtacatcgagaggggcaagaagattgatgagaacgtgcagagggagatcatcaatcaccagtcgctccggcaccctaacatcgtacggttcaaggaggtttgtctaacacccacacatcttgctattgtcatggaatatgctgctggtggagagctatttgagaaaatctgctcagyagggcgattcagtgaagatgagtccaggtatttcttccaacagctgatatcaggggtcagctactgccattctatggaaatttgtcaccgtgatcttaaacttgagaacaccctccttgatgggagtccaacacctcgtgtgaaaatttgcgactttggttactcaaagtctgctttgctgcattccaaaccaaaatcaacagttggaactccagcatacatagcccccgaggttctttccagaaaagagtatgatggaaaggtagcagacgtttggtcctgtggtgtcacgctgtacgtgatgctcgtgggatcatatccatttgaagatcctgaggatccaaggaacttccggaaaacgatcagcagaattcttggcgtgcaatactccatcccggattatgtgagagtgtcttcagactgcagacgccttctgtctcagatattcgttgccgatccttcaaagaggatcacgatcccggagataaagcatcacccgtggttcttgaagaacctcccgagggagatctcggagagggagaaggccaactacaaggacgcggatgccgccgagccggcgcaggccgtggacgagatcatgcggattgttgaggaggccaagacccccggtgacatgtccaaggtggttgacccggcgctgctggccgagatggcagagctggagagcgacgaggaagaggcagacgccgatgacacctactgatcgctcctgcatgcagctcagcagctgctcagtcatggtgtccagtcctttgtgctgcagacatggcgccgccgagcgcccgagcttaacccgtgcgtgtgatgacggatgttgtattgcactctttacgctgtttgtataataaaagtctgtacaacgctgtacaattgcagattgccttgtacagatgaactagcgtgcagtgatatactcagtcccaaattctatgttccaaaacggtttaaataattttattttttagagagatcaaaatagttttaagt

SEQ ID NO: 65 - DNA, 903 bp, Hordeum vulgare
  misc_feature (693)..(693): n is a, c, g, or t
  misc_feature (793)..(793): n is a, c, g, or t
  misc_feature (796)..(797): n is a, c, g, or t
  misc_feature (845)..(845): n is a, c, g, or t
  misc_feature (848)..(848): n is a, c, g, or t
cccacgcgtccgcagcagcaccaccaccaccaccagcagcagcagcaggaggaggaggtttgctctgagtcgggcttctctcgcggtcggattcgttcgagttggagccgcccctcgaaaccttgggagttgggattgaggcgggcgggtggtggcgatggaggagaggtacgaggcgttgaaggagttggggacgggaaacttcggggtggcgaggctggtcagggacaagcgcaccaaagagctcgtcgccgtcaagtacatcgagaggggcaagaagattgatgagaatgtgcagagggagatcatcaatcaccgctcgctccggcaccctaacatcatacgattcaaggaggtttgtgtaactccgacgcaccttgccatcgtcatggaatatgctgctggcggagaactcttcgaaagaatatgcaccgcgggccgattcagtgaagatgaggcaagatacttcttccagcaactactttcaggggtcagctactgccattctatggaaatctgtcaccgtgatcttaaactggaaaacactctcctggatgggagtccaacacctcgagtgaaaatttgcgactttggttactcaaagtctgctttgctgcattccaaaccaaaatcaacagttggtactccagcatacatagcgccggaagttctttcgagaaaagatatgatggncaggtagcggatgtttggtcctgcggcgtgacattgtatgtgatgctcatcgggttcgtacccattttgagacccccgagattcaaggaactttccgganaanncatcagtaaatcctttggcgtgcaatacttcatttccgactacgtcanggntgtcctccgactgcagacgccttctgttccaaatattcactggcgattcttcaaa

SEQ ID NO: 66 - DNA, 1307 bp, Sorghum bicolor
cctggctcttctctgctgggagagattccttttgttcggtgtcgccacaactcgccattcttgggaggtctaaggtcgtcgggatcgggaccgctgctgatggaggagaggtacgaggcgctgaaggagcttggggccggcaacttcggggtggcgaggctggtcagggacaagcggaccaaggagctcgtcgccgtcaagtacatcgagaggggcaagaagattgatgagaatgtgcagagggagatcatcaatcaccagtcgctccggcaccctaacatcgtacggttcaaggaggtttgtttaacacccacacatctcgctattgtcatggaatatgctgctggtggagagctatttgagaaaatcaccacagcagggcgattcagtgaagatgagtccaggtatttctttcagcagttgatatcaggggtcagctactgtcactctatggaaatttgtcaccgtgatcttaaacttgagaataccctccttgatgggagtccaacacctcgcgtgaaaatttgtgactttggttactcaaagtctgctttgctgcattccaaaccaaaatcaacagttggaactccagcatacatagcgccggaggttctttccagaaaagagtatgacggaaaggtagcagacgtttggtcctgtggtgtcacactgtacgtgatgctcgtgggatcatatccatttgaagatcctgaggatccaaggaacttccggaaaacgatcagcagaattcttggcgtgcaatactccatcccggattatgtgagagtgtcttcagagtgcaggcgccttctgtctcaaatattcgttgccgatccttcaaagaggatcacgatcccggagataaagcatcacccgtggttcctgaagaacctgccgagggagatctcggagagggagaaggccaactacaaggactcggatgccgccgagccggcgcaggccgtggacgagatcatgcggattgttcaggaggccaagacccccggtgacatgtccaaggtggtcgactcggcgctgctggccgagatggcagagctggagagcgacgacgaagaggcagacgccgatgacgcctactgatcgctcctgcatgcaactcagcagctgcagacgccgccgagccttacccgtgcgtgggataacggatgttggattcttactctgtatgataagtctgtatagcgctgtacatttgaagattgccttgtatggatcaactagcgtgcagtgataacaaataaatataagtgagtaaataaagatgtaccatacgctgtttagctgct

SEQ ID NO: 67 - DNA, 1334 bp, Glycine max
  misc_feature (1274)..(1275): n is a, c, g, or t
  misc_feature (1278)..(1280): n is a, c, g, or t
  misc_feature (1325)..(1326): n is a, c, g, or t
ctcttctctgtcattaactccttgagaggttggtgtagtagctttttggagggttgacatggaagaacggtacgagccattgaaggagcttggagctgggaattttggtgtggcaaggttggccaaagacaaaaaaactggagagcttgttgcggtcaaatacatagagaggggcaaaaagattgatgagaatgttcagagggagataattaaccaccgatctttaaggcatccaaatataatcaggttcaaagaggtgttactgacccctacacatttagctattgtcttggagtatgcttcaggtggtgaactttttgagaggatatgtactgctggtcgatttagcgaagatgaggcaagatatttcttccagcagctaatatctggggttagctactgtcattcaatggaaatttgtcatagagatctaaaattggaaaacactctcttggacggaaatccatctccccggcttaaaatttgtgactttggttactccaagtctgctttactgcactctcaacctaaatcaacagttggaactcctgcatacattgctccagaggttctgtcacgaaaggagtatgatggaaagatttcagatgtttggtcctgtggagtgactctttatgtcatgttagttggtgcatacccatttgaagatccagaagatcctagaaatttcagaaagactattgggagaataatcggtattcagtactccatacccgactatgttcgtgtttcttctgactgtaggaatcttctctctcgcatctttgttgctgatcctgccaagaggatcaccatcccagagataaaacagtatccttggtttctgaagaatatgcctaaagagatcatcgaagctgaaagaaaaggattcgaggaaacaaccaaagaccaaccaaaccagaaggtggaggaaatcatgaggataattcaagcggcaaggataccaggacaaggatccaaagctggagaaggtggacaagctggcactggatcattagatattgaggatgatgaggaaattgatgttagtggtgactatgaacaagtgtgatcgagaacttgattagttgatatggctagattgtctataagacatagtcagcattattaacatctatcacagtgtgcaacactggtgttctaaagatacttgttataccaggcttgaaataggattttgtgtttatttaaatgaataatattaagaaaaggctgctatttcagtttcagtaaatcattggtgttgttcctagtcnnctnnntattccaaattttaatactttgtataaaaagaagtatttgatatnntcacacaa

SEQ ID NO: 68 - DNA, 1348 bp, Zea mays
gggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaggctctgtatgagctgttcaagaagattagcagtgctgtggttgatgatggcttgattaacaaggatgaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatgacaaaattgattttgctttcaaattgtatgatctcaagcaacaaggtttcattgaaaagcaggaggtcaagcaaatggtggtcgcaacacttgctgaatcaggaatgaatctttcagatgatattattgaaggcattattgataaaacatttgaggaagcagatacaaagcacgacggcaaaattgataaggaggaatggcgcagccttgtcttgaggcatccatctctgttaaaaaatatgaccctcccatatctccgggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtctgtgtttataaaatattcttcaaacatattgctcataaaaactactcaaagtaagaatcaaattgagtacaaaactactcaaagtaagaattgaattgagtacatgtgatgccacaaaagatggaaatgctctttgcctcctttggcgggatgagctcaaaagccaaacctttgtcggagcataaacacaaccttatttgttgtgtttggtaggtagtgtttggttgtggagttaaatagaccgagccgctcggtatagaattgagctgctttaaaagtgaaatatttttttaatatttt

SEQ ID NO: 69 - DNA, 1076 bp, Zea mays
tcgcccgctcgctccgcgctccctccccccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatatgtcacacgcaactttggacagaactattatactagtactaagcttctcgccg

SEQ ID NO: 70 - DNA, 917 bp, Zea mays
gaattccattgtgttggttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgctttcaacgccatgccatgccactggagaatgagatgttcttcttcactgctttataatgggttgatgtacaaaatacgatatggaagtgcctggggaactagttcccggagggaactcttgcacactgcgcccccaaaaactagagttgaagatgtaaaacgccgtcgtccgccgagggacgacgagagattgtacgtgatacatcgatcgagtctcgtgaacctaaaaagctgtgaagaagaacatctcattctccagtgacatggcatggcttggcttggaagcatcaatcgtcgacagggtcctgaggagcttcggtagc

SEQ ID NO: 71 - DNA, 1529 bp, Oryza sativa
ggacactgactggactgaaggagtagaaacttcttcttcttgccgaggaagccaaagcagcgggagcaaagcggagcgcaatggcggggtcgtcggagccgacgcgggtgatggtcgcggtgaacgagtcctcgatcaagggctacccgcacccctccatcagctgccgcgccgccttcgactggatgctctccaagctcgtccgctccaacgccgccggcttccacctcctcttcctccacgtccaggtccccgacgaggacggatttgatgatatggatagcatctatgcatctccaccagactttcagagaatgaaacagagagacaagataagagggcttcacttgctcgagcactttgtgaatcaatgccatcaactggagataaaatgtgaagcatggattaaacaaggggatccaaaggaagtcatctgcagcgaggtgaagagagttcaaccagatcttctagttgtgggaagtaggggccttggaccatttcagagggttttcgtgggcacagtgagcgagttctgtgttaagcatgccgactgtccagtcatcaccatcaaacggaaggccgatgaagcaccgcaggaccctgttgatgattgatcccttcaatgtcatacttgagaatgagatattcttcactgctcaatgggtttaatgtacaaaatacaatatggtagtagtgcttggaactagtacaaatctttgcccagtccaccccaaaactagagtgaagatgaagaacactattgcgacaagaggttgtatcctatatgagatacatccaagtttgttatgaacctaagctaccttgatgatgaatcacgtactgggcttcgcagaaatgaatgttccacctcttatctgcccttgcctgaccacatttgcagggtacctgaaacctgggggcatgggcatgccgtgctgcggatggtgttggggcatgccatgctgctgtggatggtgttggtgttggtgttgttgatgttgctgctgatgccctttgccgtctcccttgctgtcgttcttccatgctgcaggtttccctggggtgaacttgatctcgaagccgtcgtcgatgtcgtggatcatggcgcgggagctcgccatcggcttcatcaccgggtacttgatctcgaaccccttctccaggtcgccgccgacggcattgatgccgtagaactggtcctcggcggaggccgccctcttcttggagagccgccggccgcagagccggccgacgacgcaggcggcgacggcgaggaaggtgatcacggcgagcacggtgaacaccgggccgaacgagcccctggacgtggtggccggctgcgcgtgcatgatggagttggaggttgggtagtaacccatgggctgaggtaaagacgccatcttccacttctcttgtgtcactcttctgctggtttttagctcttgttgcaaagctactgctcactgctcttcactcttctctgcctcttcttgactaggaaatggcttgtgtgatggaatggaagtgtc

SEQ ID NO: 72 - DNA, 1604 bp, Sorghum bicolor
gcacaaggaaaacttctcctcttcttgacgaggaaggcagcccgagcgagcgagcgaggcgtgcgtgcgctgcaatggcggactcgtcggcgccgacgagagtgatgatggcggtgaacgagtcgtcgctcaaggggtacccgcacccctccatcagctgccgcaccgccttcgactggacgctctccaagctcgtccgctccaaccccgggggcttccacttcctcttcatccacgttcaggtccccgacgaggacggatttgatgacatggatagcatctatgcttcgccggaggacttccaccaaatgaagcggagagacaagataagagggcttcatttgcttgagtactttgtaaaccaatgccatcagttagggataaaatgcgaggcatggatcagacatggggatccaaaggaggttatctgcagcgaagtgaagagagtccagcctgaccttctagttgtgggaagtaggggccttgggccatttcagagggttttcgtgggcacggtgagcgagttctgcgttaagcatgccgaatgccccgtcatcaccataaaacggaatgctactgaagctcctcaggaccctgtcgacgattgatgctttacaagccatgtcactggagaatgagatattcttcactgcttataatgggtcaatgtacaaagcacgatatggaagtgcctggaactagttcgcgtagggaacttttgcacagtacgccccaaaactagagtgaagatgaaaacgctatcgttcgcccgagggatgatgagagattgtaccacgtatcatatgtgatacatcaatcaatcgagttgtgaacctaagctgctgctatatgttcatgtgccaggctttgctggaatgaatgccccgccccttatttgcccctgcctgaccacggcttccgcagggtatctgaagcccgcgtactccttgggcacggcgtagcctttgggaatgccaacgagctggtgctgctggtgctgatgctgaagctgatgctggccgtggccctggacctggacctggacctgatgccgacgccccttgttgtcggccttgctgtcgttcttccacgccgcaggcttccccggcgcgaacttgatctcgaagccgtcgtcgatgtcgtggatcatggcgcgagagctcgccatgggcttcatcgtcgggtacttgatctcgaagcccttctccaggtcgccgccaacggcgtcggagccgtagaagtcctggtcggcggacctcttcctggagagccggcggccgcaaagcctgccgacgacgcaggcggccacggcgaggaaggagatcaccgcgagcacggcgaagaccgggccgaacgagcccttggacgccgccgcggtggacgacggctgcgcgcgcaggatggcgttagaggacgcggggtagtacaccgtgggatcaggcaaggaagccatgtcctttgcttctctcagccagctagttccttctctcaagctgctgctgctgctgctgctactactactacccacgctctccctcgaagaaatggtcactcccctgctctctctccctctaagcaatggttcggccgtttgggcctcgtgc

SEQ ID NO: 73 - DNA, 1150 bp, Zea mays
gcacgaggtgctaaccagtgcaggggaggattagcgatcttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctgtgtttgaggcgctggagggggacgctaggaacgtcctctgcgaggctgtcgagaggcacggggccgagatgctcgtcgtcggcagccatggttacggagccattaaaagggctgttcttggaagtgtgagcgactactgtgcccatcacgcgcactgcaccgtgatgatagtaaagaagcccaagcagcacaagcactgatcaatgccgactgatcactacgtgtactgcaaataatttgtactactgcaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttcttttctgtgagccgtgggcgtgtatgcacgttttaggtggagaaaatggtataaatcagatgaaagggtgaatgcacgtgatgaactcatcagtctgatacatgctccgaacttgattacacagccatgccatttacatgttcttgcatgttgaagttcgattgaacagcacttcttcaaattcaaaatattgatgtcg

SEQ ID NO: 74 - DNA, 871 bp, Glycine max
acgaggactaaagagagttgtggtgtggtggtggttgtcgtttttgaaatggcagcgtcgtcgtcagagaagcaagtggtggtgataggcatagacgacagcgagcagagcacgtacgcgttgaattgggctctggataactttttcccgagcccaattttcaagctcgttctcatccactccaggcccaccgccacctccgctgtgggcttcgccggccctggagccgctgaggtcttgcctattgtagattccgatttgagaaagattggcgccagagtcctcgaaaccgctaaacaactttgcatcaacaaatccgtaaatgatgtgacagcagaagtggtggaaggtgatcctagaaatgttctttgtgatgctgtagataagtaccgtgctgcaatgttggttgtgggtagtcatggttatggggctataaaaagggcggttttaggtagtgtcagtgactattgtgctcatcatgctcactgcactgtgatgatcgtgaagaagccaaaaatcaaacactgatctgtaatggctgcgtctatatagtacaacaataaacataatcctttcagccaaagaagagagaaagaaaataatgttcacagaaattcgtaactatgcttgttgtatggatatggcttattgactttatggtttgatacgttgaggcacagtttatttttaaagatggaaccatcagaaaatatgtacgtatcaggactttaccttacattgtacacgaaaagttcttgaactgatgagttcaattccattactgctcttttcatccttaataaaataaaatagtaaaaaaatattgtactagtttattgcaatgcactactagcctgaacaatttctagtt

SEQ ID NO: 75 - DNA, 908 bp, Hordeum vulgare
ctcgtgccgaattcggcacgagggatcgtgcagcgtgtcgcaggagagaagcccaagctctggtgcaggcagccatggcgggggaaacgggggcgacggcggcttcggggccggcagcgggcaagatgacgatggtggtcggggtggacgagagcgagcacagctactacgcgctgcagtggacgctcctccacttcttctccccggggcagcagcagtaccgcctcgtcgtcgtcacggccaagcccaccgccgcgtccgccgtcggcctcgccggaccaggtgccgcggacgtgctgccgttcgtggaagcggacctgaagcggagctcgctgcgcgtcatcgacaaggccaaggagctctgcgcgcaggcgcaggtgagcgatggtgtcttcgaagtggtggagggggatgcaaggaacgtcctctgtgaggcggtggaaaggcatcacgcagagatgctggttgtgggcaaccatggctatggagcaatcaaaagggctgttcttggaagtgtgagcgactactgcacccaccacgcgcactgcaccgtgatgattgtgaagaagccaaagcacaagcactgagcaacgcccagccttgactggtcgctgaacccagtgatcggtatttgtgcatgtttgtgaataaatggatcgcagatgtcacagttcacaccttcagaagagtagtgaactcctgcaagtagctacatgtggattcttgtttgagatggtgaataactgatgcgcctcatcagaacactgttatttgtgattgcagattcatgcattgtacaagcgttgtatgtatatgtaaatttaatcaagactgcaagtcccttgcagtggacacgtgtgtttacttcttgtagaagtgtggtttgtaaattcattcctcttctgttc

SEQ ID NO: 76 - DNA, 779 bp, Sorghum bicolor
cggggaagatgacgatggtggtcggggtggacgagagcgagcacagcttctacgcgctgcagtgggcgctgcagcacttcttcccgccgccgccacagccgcagcagtaccgcctcgtcgtcgtcaccgccaagccttccgccgcctccgccgtcggcctcgccggcccaggcgccgcggatgtgctgccgtacgtggaggcggacctcaagaaaaccgacctgcgcgtcatcgacaaagccaaagcactctgcgcacaggtgagcgacgccgtgtttgaggcggtggagggggacgctaggagtgtcctctgcgaggcggtcgagaggcaccacgccgagatgctcgtcgtcggcagccatggctacggagccatcaaaagggctgttcttggaagtgtgagcgactactgcgcccatcacgcgcactgcaccgtgatgatagtaaagaagccgaagcatcacaagcactgatcaatgatccagtttgacagatcactacgtatacttcaaataatatgtactgcaaagttgtgtatatgcgccagtttgtgaataattggatcatcaaccatcacacgttcggttgcttctgcaagtagtatccgatgcatgcatgcaatccttctacatggggattgggaattaccaataattgattgttctctgaacctcaaaacaatgtatttgtatcaatgtgttgacgtatatgtgattgcaacttctttactgtgagctgtgtgcgagtatgtacattttattaggtaagaaaatgttata

SEQ ID NO: 77 - DNA, 970 bp, Zea mays
gcacgaggtacaatctgtgacaagtgtcctttggcttggcatccataggccaccgccatcagcagtccaatacagtgacctgacctccacgcgaagccaccaccacaactccacaagatctagaacctaagaacctgcagaggagaggaagaggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccggctccccgttgattcccctctcggaattctctgaccctatcattgcgaagaaatatggagcaaagccggacatagaaaccttggacatcctgaacactacagctacccagaaggatatcgtggtggttgtgaaagtcctgtggggtgatccgcgtgagaagctctgtcaagttatccatgataccccgctgagctgcttggttataggaagcaggggccttggcaagctcaagagggtgctcttgggaagtgtcagcgactatgttgtgaacaatgcaacctgccctgtcaccgtcgtcaagtcaacaagcaccgaaggttgatcttatcgccgagatgcctggatgtgatgttgtaataaagatggttggcctgatgaagaacatgcactagtttctagctatttgaaacatgttgaacgaggcaattctaatgtaataataatagacaaagtgccttatgaaggacatggttgacatgcctttgttgctgtatgagtgatgtttatagttttgagggtttgaagatgtggatcatttgcctattattcttccgctgtgctgtatgagcgatgtttatcaatatgcaatgcaaataaagaaacactacagatgcaaattc

SEQ ID NO: 78 - DNA, 640 bp, Zea mays
cgtcagataaaggagctgaggggcatggtggaaaagcagatggaggtgaagctggagtccgcggcggaggagctgctgccggtggcgacgaggtcagcagcagcagccgctgtgtataacaaggacgggtcgacggacagcgactcgagcgccgtgttcaacgaggaggcgtcgccctacccttactccggcgcggccttagaccatcagcagcagcaagaaaccagccacccgctgggcttcacgggtttcacctccttcttgacgtcctctttcccttccgtataccatggggattcgcatttggaccaggaagcggacgtcttcttcagcgccgccgccgccggcgacggattcttcgccgaggagcagagcgcaggcatcggcagctggtacggcggtgagggttggtagaacagcaacagctaagctgttggctgcctggaggctggagatcactcttggtatcgtatctaccattcttgtaaaatatggcgctgtacattatattatgcatgcatgggtccgggacgcggtaactatatactactatgtagagttaatttatatggagtagttaatttctgtatttttcactggcgggctgaaagcctgaaacacgggctatgaaaggagatag

SEQ ID NO: 79 - DNA, 1608 bp, Zea mays
cgagtcgcggcgcccgctcgtggccggtgcgcgcgtccacaaccgccgccaccgccttcccacttccaaatacgcctgctgccactttccccattcctgtctgaccatccccacgcccccctgctgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttcgtgtgtgtgaaaccattt

SEQ ID NO: 80 - DNA, 2789 bp, Zea mays
attgtgttgggctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcagcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaaacacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggcgacggcgacggcgagcaggcgccgggcgggctgaagcgactggtggccgagaccaaggacgcgcacggcgtgaagcaggtgtacgtgtggcacgccatggccgggtactggggcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggtggtgttttttttgtacaacggctgcatctcctgcatgtgccacaactccgacatgctctacagcgccaagcagaccgccgtcgtgcgcgcctccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcaagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctggtgacggcggcgggtgggacggcgagaccgtggtgtatgcgcaccgcacgcgggagctagtgcgactgccccggggcgtcgcgctgcctgtgacgctaggcccgctccagtatgaggtgttccatgtgtgcccgctccgcgccgtcgtgccgggggtctcgttcgcgcccgtcgggctgctggacatgttcaacgccgggggcgccgttgaggagtgcgacgtgatcagcgatgctggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgctggtgccggagcaggagctatacctttggacgctggagattatgatctaggtcgtgatgctgtgcgccgacgccaacgcttgccttcgcggctgagccattatgagtcggacgacattgtcatttgctatgtgcacgagagatagatgtattgtggtggtgttgtataattggcatggggagtgttttttttgttatgttcttatctgtatatcatacgtgctctgaatgttatataatacttgataataaaggatggtgctccttt

SEQ ID NO: 81 - DNA, 2616 bp, Oryza sativa
gggcgagcgagcacgaggcactcaccgccggcggcgaccgaagcaaatccggcattcgcctgagccggcgagattcggagtcggagaggaggaggaagaagatgacggtgggagccggggtggcggtgcaggacggcggcctggtggcgctgggcgccacggtgctgacggaggtgcgcgacaatgtgctcctgacgccggccgccggcgccggcatgacgagcggcacgttcgtcggagtccgctccgccaccgccggcagccgcagcgtcttccccgtcgggaagctcaggggattgcggttcatctgcacgttccggtttaagatgtggtggatgacgcagaggatggggacgtcaggccgcgacatccccttcgagacgcagttcctcctcgtcgaggccgccgacgccgacggatcacacctcgccggcgacggcgccgccgcggtgtacaccgtgttcctcccgatcttggagggaccgttccgagctgtgcttcaggggaactctgatgatgagctcgagatttgcctcgagagtggtgacccagctgtggaatcattcgaaggcacgcatctggttttcgtcggtgccggatcggatccattcgaagtcatcacaaattctgtcaaggctgttgagaggcacttgcagacgtttactcacagggaaaagaagaagatgccagacatgctaaactggtttggttggtgcacatgggatgcgttttatactgatgttacttcagaaggagtaatggaaggattacagagtctaggaaaaggtggaactggcccaaaatttgtgataattgatgatggatggcaatcagttagtatggatcctgcaggaattgcatcattagctgataactcagccaactttgcaaacaggttgactcacataaaggagaaccacaaatttcagctaaacgggaggaaaggtcacagggaagagaatccggcaaatggccttgcacacattgtcaatgaaattaagggcaaacatcagctgaagtatgtttatgtgtggcacgcgatcaccggatactggggtggagtaaggcctggtgctgatggaatggagcactacgaatcgaagatgcagtacccggtctcatcaccgggagttcagaagaacgagccatgtgatgctctgaacagcataaccaccaacggccttggccttgtgaaccctgacagagtgttcagcttctacaacgagctacacgcctaccttgcatctgctgggatcgatggagtgaaagtagatgtgcagaacattcttgagacactgggtgctggccatggtggaagagtgcttctggcaaggaagtatcaccaggctctagaagcttccatcgcccggaacttccgcgacaacggcatcatatgctgcatgagccacaacacggataacttgtacagttctaagaggagtgctgttgtgagagcttctgatgatttctggcctagagaccctgcttcccatactatacatattgcatctgttgcatataatactgtatttcttggagaattcatgcaaccagattgggacatgttccatagtgttcacccaatggctgaataccatgctgcagcaagagcagtcggtggctgtgccatatatgtcagtgacaagcctgggaaccatgacttcaatttgctgaagaagctggttcttcctgacggatcgatcctgagagccaaactccccggcaggccaaccagagactgtctgttttcagaccctgcaagggatggcaagagtatcctgaagatatggaatctgaacgagcactccggtgtgattggcgccttcaattgccagggtgctggatggtgcagagtagggaagaagaacctcgtccacgacgagcagccggcgacggtcaccggtgtcatccgtgcacaggacgtgcatcacctcgcaaccgttgctgccgatggctggaacggcgacgtgatcgtctactcgcacatcggaggggaggtgacctgcctgcccaagaacgcgtcgttgccggtgacactgaagacgcgagagtacgaggtcttcaccgtcgtaccactgaagaagctcgacaatggcgtctccttcgccgcggtcgggctgatcgggatgttcaactccggcggggcggtgacggcggtgaggtacgtggaggacgccggcgttgaggtcagggtgcgtggctccggcacggtcggggcgtactcctcggcgaagccggcgagggtggtggtggattcggaggcggcggaattctcctacgatgatggatgcggcttggtcacgttcgagctcgccgtgccggagcaagaactctactcctggaccatctcgatcgagtactgacgtagtgacgttgcttaccatgaagtttctcaatgtttttcatgatgaaaaatggagtggatgagatttctgaaaatatattcaggttcttgctgaatcccgggttgggaattcagcatggtgctgaacattgtaagctaaggttgagatgttcgcaacattcttgctgcatatgttgcggctaattcgtgttattccgagcatacacatacagtatgcaaaaatccaaagggaaaaaaaaatggtttctgcc

SEQ ID NO: 82 - DNA, 2714 bp, Hordeum vulgare
gccccctctccggcgagggcaccgcaccatcttatatcattagattagtactggttccagttaccggcacgcaaagcactctctatcgatcactctatcatatactaccatcgtccgttatctatcaatcgctcgctacttgctagctccggccgtatcgaagctagaaggggtggtcggagatgacggtgacgccgcagatcacggtgggcgacgggaggctggcggtgcgcggccggacggtgctgtccggcgtgccggacaacgtcaccgcggcgcacgctgccggggccgggcttgtcgacggggccttcgtcggcgccacggccgccgaggccaagagccaccacgtcttcaccttcgggactctccgagattgccgattcatgtgtctgttccggttcaagctgtggtggatgacgcagcggatgggcacctccggccgcgacgtcccgctggagacccagttcatcctcatcgaggtccctgccgccgccggcaacgacgacggcgactcctcggacggcgacagcgagcccgtgtacctggggatgctgccgctgctggaggggcagttccgcacggtgctccagggcaacgaccaagacgagctccagatctgcatcgagagcggggacaaggcggttgagacggagcagggcatgaacaatgtgtacgtccacgccggcaccaaccccttcgacaccatcacccaggccgtcaaggctgtcgagaagcacacgcagacgtttcaccacagggagaagaaaacggtgccgtcgtttgtggactggtttgggtggtgcacgtgggacgccttctacacggacgtgacggccgacggcgtcaagcaggggctccgcagcctggccgagggcggcgcgccgccgcggttcctcatcatcgacgacggctggcagcagatcggtagcgagaacaaggatgaccccggcgtcgccgtccaggaaggcgcgcagttcgcgagccggctcaccggcatcagggagaacaccaagttccagagcgagcataaccaggaggagaccccggggctgaagcggctggtggacgagaccaagaaggagcacggcgtcaagagcgtctacgtctggcacgccatggccggctactggggcggcgtcaagccgtcggcggccgggatggagcactacgagccggcgctggcgtacccggtgcagtcgccgggcgtcacgggcaaccagccggacatcgtcatggactcgctctccgtgctcggcctcggcctcgtgcacccgcgcagggtccaccgcttctacgacgagctccacgcctacctggccgcctgcggcgtcgacggcgtcaaggtggacgtgcagaacatcgtggagaccctcggcgccgggcacggcggccgcgtcgcgctcacccgcgcctaccaccgcgcgctcgaggcctccgtcgcgcgcaacttcccggacaacggctgcatctcgtgcatgtgccacaacaccgacatgctctacagcgccaagcagaccgccgtcgtgcgcgcctccgacgacttctacccgcgcgacccggcgtcgcacaccgtccacatctcctccgtcgcctacaacacgctcttcctcggcgagttcatgcagcccgactgggacatgttccatagcctgcacccggcggcggagtaccacggcgcggcgagggccatcggcggctgcccgatctatgtcagcgacaagccggggaaccacaacttcgaccttctcaggaagctcgtgctccccgacggctccgtgctccgcgcgcagctccccggcaggcccacgcgcgactgcctcttctccgacccggcgcgcgacggtgccagcttgctcaagatatggaacatgaacaagtgcgccggcgtggtgggcgtgttcaactgccagggcgccgggtggtgccgcgtcgccaagaagacgaggatccacgacgaggcgcccggcacgctcaccggctcggtgcgcgccgaggacgtggaggccatcgcccaggccgccggcaccggcgactggggcggcgaggccgtggtgtacgcgcaccgggcgggggagctcgtgcggctgccccggggcgccacgctgccggtgacgctgaagaggctggagtacgagctgttccacgtctgccccgtccgcgccgtggcgccgggcgtctcgttcgcgcccatcgggctgctccacatgttcaacgccggcggcgccgtcgaggaatgcaccgtcgagacgggcgaggacggcaatgccgtcgtggggctcagggtgcgcggctgcggccggttcggcgcctactgctcgcggaggccggcgaaatgctccgtcgactcggctgacgtggagttcacctacgactccgacaccgggctcgtcaccgccgacgtgccggtcccggagaaggagatgtaccggtgtgcgctcgagatccgggtctaggctgccatgcttgtgttcacgatcacggggatggttggggcggtctcagccgttggattatttccattgttcgtgcttattggttgagagagattgattgagagatgagcgattgtcatgtagagagattgtgctttgctctatcactgtcgcgtatgcaataatgttatcactgtattgttgtcgatgaatgcaataaaagatggtgctccttgtaaatcagtggcatcgatgatcctcattaattcaaaagcttgc

SEQ ID NO: 83 - DNA, 2829 bp, Sorghum bicolor
cccgccagtttctccctcccagtcgagggagcaccattaccaagtactgtagtttagtgctgcttatattaccattactatattattattactgctgacttaattaccctcacgcggcgagtgaagccctctctacctttgattgattccgcacttgttgttcttgcgcgcattgcagagagggtgctctcgatccatctctgcagttttatctcttaggttttaatcaaatcaaatcaacatgacggtgacgccgtggatcacggtgagcgacgggacgctggcggtgcgcggccgcacggtgctcaccggcgtgctcgacaacgtgtccgcggcgcacgccgccggtgccggcctcgtcgacggggccttcgtcggcgcccacgccgccgagcccaagagccaccacgtcttcaccttcggcacgctccgggactgccggtttctgtgcctgttccggttcaagctatggtggatgacgcagcggatgggcgtctccggccgcgacgtgcctctcgagacccagttcatgctcatcgaggtccctcctgccgccaccgacggcgacggcaaacccgcgtacgtggtgatgctgccgctgctggaggggcagttccgggcggcgctgcaggggaacgaccgcgacgagctggagatctgcgtcgagagcggcgacaaggcggtgcagacggagcagggcgcgcgcatggtatacctccacgccggcgacagccccttcgacgccgtcaccgccgcggtcaaggcggtggagaagcacctgcagacgttccaccaccgagagaggaagaggatgccgtcgttcctcgactggttcggctggtgcacctgggacgccttctacaccgacgtcaccgccggcggcgtcaagcacggcctccagagcctgtccaagggcggcgcgccgccgcggttcctcatcatcgacgacggctggcagcagatcgcctccgacaacaagaagcccgacgaccccaacgtcgccgtccaggagggcgcgcaattcgccagtcggctgacggggatcaaggagaacaccaagttccagaccaagccggacggcgacggcgacggcgacggcgggctgaagcggctggtgtcggagaccaagggcgtgcacggcgtgaagcaggtgtacgtgtggcacgcgatggcggggtactggggcggcgtggcgccgtcgtcggggacagcgatggagcgttacgagccggcgctggcgtacccggtgcagtccccaggcgtgacggcgaaccagccggacatcgtcatggactcgctgtccgtcctgggcctcggcctggtgcacccgcggcgggcgcgggacttctacggcgagctccacgcgtacctggcctcctgcggcgtggacggcgtcaaggtggacgtgcagaacatcatcgagacgctgggcgccggccatggcggccgcgtcgcgctcaccagggcctaccaccgcgcgctcgaggcctccgtggcgcgcagcttccccgacaacggctgcatctcctgcatgtgccacaacaccgacatgctctacagcgccaggcagaccgccgtggtgcgcgcctccgacgacttctacccgcgcgacccggcctcccacaccgtccatgtcgcctccgtcgcctacaacaccgtcttcctcggcgagttcatgcagcccgactgggacatgttccatagcttgcacccggcggcggagtaccacggcgcggcgagggccatcggcggctgcccgatatatgtcagcgacaagccggggaaccacaacttcgagctgctcaggaagctcgtcctccccgacggctccgtgctccgcgcgcagctccccggccggcccacacgcgactgcctcttctccgacccggcgcgcgacggcgcaagcctgctcaagatctggaacctgaacaagtgcggcggcgtggtgggcgtgttcaactgccagggcgccgggtggtgccgcgtgacgaagcggacgcgcgtgcacgacgcggcgccgggcacgctgaccggcgccgtgcgcgccgacgacgtggacgccatagcgcgcgtcgccggcgacggcggcaacgatggcgacaacggcagcaacggcgagtgggacggcgaggccgtggtgtacgcgcaccgcgcgcgggagctggtgcggctgccgcgtggcgccgcgctgcccgtgacgctggcgccgctgcagtacgaggtgttccacgtgtgcccgctccgcgccgccgcgccgggggtggcgttcgcgcccgtggggctgctcgacatgttcaacgccgggggcgccgtcgaggagtgccgcgcagtggacggcggcgggaaggccgtggtggcgctcagggtgcgcgggtgcggccggttcggtgcctactgctcgcgggagccggcgaggtgcctgctggactcggcggaagtggagttcggctacgacgccgacaccggcctcgtgtccgtcgacctgccggtgccggagaaggagatgtaccggtggacgctggagattgtggtctaggccgttacacagtgcgccggcgcatgtcttggcggctgagccattctgagccgtaccaccattggtgccattttgcgatgtgcacgagagattgggagagcgcgtgcgatttgtggatgtagtgtctcgttatataattggtatgcgtgagagagtatgctttgctatgtcggtgtcagtataccctgtgtgctctgagtgttgtataatactgtagtactgggtaataaaggatggtgctccttcaatatgaatctcttctttaaacatgacttaatacatatcacattcgc

SEQ ID NO: 84 - DNA, 1664 bp, Zea mays
  misc_feature (1650)..(1651): n is a, c, g, or t
cgttgctgtcggctacagggaaacaactgatacttacacaatcgctgcatcaccgagctttggttacttgggcccttctacaagcaaatactcactcctcgatcttggtcgtagtggtcttggttctgacctgaagttgcctctagtgtcggacaaggctgatggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgctggtgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttatataccgagctatatacatattgtgtggaattcattattttggagggtgataacctcacaacaatttttcctaaagctggagttgattggtttggcattcatgttgatgggaagcattttttcggagtgttaaccgctattttagtcttgccaacagtatggctgcgagatcttcgagtgctctcttacctttcagccggtggtgtgattgcaactcttctagtattcctatccgtcggtttagtcggtgctacggatggtataggctttcattcaactgggaaggcagtaaactggagtggcatgccttttgccattggtatttatggattttgctactccgggcattcggtatttccaaatatctaccagtcaatgtccgatagatctaagttccctaaggcactggtcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatggtcaggttttactgtacgaccaaatttttactagaactaccggatttcctgtacattattgctgctgttattattcggaccacactagcctactaaaaaggaacacttccacataaggtaatcttgcgcacctttacctgaggtctttatcannttagtgtactggt

SEQ ID NO: 85 - DNA, 585 bp, Sorghum bicolor
cactatggaccacggtgatcaaccctttcaccaaatatgccttgttgttaaacccattagctcgaagtttagaagagttgcgtcctgaaggctttttgaatgaaacatcatgctctataatactgaggactgcccttgttgcatcaactgtatgcattgcgtttcttctgccgttctttggtcttgtgatggcgctcattggatctcttcttagtatacttgtggcagtcataatgccagccttgtgcttcctgaagatcgcacagaataaagcaacttgttcacaggtaattgcaagcattggtatcataatattgggcgtcatcagtgctgccctggggacctattcgtccgtgaaaaggattgcagaaaactactaagctcttggacagtttctgtctgcagagtctaccacccgattccaaggatggaactcgaaatggtcaggtttcactacgatcaaaattttgctagaactaccgtgtttcctgtagattattattactattattatttggaccacaatagtctactaaaaaactgcatatcacttgcaataatgtaaggtaatcatgcccccctttt

SEQ ID NO: 86 - DNA, 1384 bp, Zea mays
ccacgcgtccggcggcgtgcgatcgatcgaggcagtcgtagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtcgatggcaacggccatgaccaacttgatccccgccatcaccttcgtcatggcggcatcagtcggcctagagagggtggaggccaggaggccgaggagcctggccaagatcttcggcacggccgtctgcgtcagcggcgccatggccatggctttcttcaagggcccgaagctgctcggcgacggcccgaacgctctccagctcctcctccacgcgggcggcggcggcaggtgggtggccggcgcgctcttcctcgtggccagcagctcctgctggtcgctctggctcatcctgcaggtgcccatctgcaagtcgtacgtggagccgctggctctgtcggcgtggatgtgcgtcctgtccacgctccagtccgcgctgctcgtctccttcctcctgccggaccccagcgcctggaggatccactcgctcttcgagctctcctgctgcgtcttctcgggcgtgttcgggtccggcgtcacgttctacctgcagtcgtggtgcatctccgtgaggggcccgctctactccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaacaagggcggggtggagccagagcaccactcggacgatctggagaagacgtcatcagcgcggtcggatcccaattcgacggccggcgtcggcagtggcatcgccgagcccctcctggcgggcggcgatccaacggagaagtagatgggattttgctgctcttcaagtgttctgtgcgtgcgcgcgcggtgttttcagggtcggtatgctagtgctactgtaacagtgccgtcccagttttgtcatgtacactagtggcagcttcaaatgactccgtgctgccgatgtgtattatccgcacaattttgttaagcaacgcggcgtccccgtcc

SEQ ID NO: 87 - DNA, 1800 bp, Zea mays
aggaaggaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaattgcgctgcaggcctccgtcatcataaacaatgtcggcgtgctaattgtttacatgattatcattggtgatgtattatctggaacaacatcaggcgatgttcatcatcgtggtatattggagggctggtttggagctcatttgtggaattctcgtgccattgttcttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttggatgggttgctcttccccacgtcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttagggattcttacggaatcgcgagcaagcgcgacaagattctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaggtcttggaaacagccttttccacaataatgtacagttattatgccaatttctgagttcagttaaattttgtgaaatatggacatgggcgtcttgtctcgattaaaattgagaatggtatgattgcacattacgtcgctaccatgtttgtttttgcctt

SEQ ID NO: 88 - DNA, 1832 bp, Sorghum bicolor
tgttggcctctggagcttcctctctgtgcagtacaagttgtcctctctttggtttagtttagtttgcgctgctggatttgttcaggcttttggtcttgagttgaggaaaaaagatttggggttcttgaaaggtgagtgaaacaaatgggtattgggaatggatcatcaagcaatgtgtcgcacaaagcgatgcaagatgagaccacgccgcttctcccgatcaaagctgaggaggacgtggttcacgagttcgatggagcttctttctctggtgcagtcttcaatctgtcgacgaccattgtaggggctggaatcatggctctgcctgcgagtatcaagatgctaggccttatccctggtattctaatgatcatccttgtggcgttgctcaccgaggcatccattgacatgctggtcaggtgcagccaccagggcaagattacatcctacgggtggttgatgggtgacacttttggtcagtgggggagaattgccctacaagcatcagtggtgataaacaatgtcggcgtattgattgtatacatgattattattggcgatgtcctatcaggaacatcatcaacaggtgttcatcacagtggtgtatttgaggggtggtttggacctcatatgtggaattctcgtcccattgtactcctcactacaactcttgttgtatttgctccattggtgagctttaagcgtctggattcattgagatacacatctgcactatcagttgctcttgctgtggtttttgttgtaatcactgctggggttgctattgtcagactcatccaaggaactgtggagatccccaaactctttcctgagatagatggagttagttctgtctggaaactgtttacagctgtgcctgttcttgtcactgcctacatctgccactacaatgttcacagcattgataatgagctggaggacaagacccaaattaaaccaattgtacaaacttcactgggactctgctcaagtgtttacattgcaacaagcttctttgcatatctcctcttcggcgaggctaccttggctgatgtgcttgccaatttcgattctgaccttcgcattccattcagctctgtcttcaatgacatagtgagagtgagctatgttgtccatatcatgcttgtctttcctatagtcttctttgcccttaggctcaacctggatggattactctttcccaccgcaaggcacatttcccatgacaacaagaggttcaccattatcaccatctcgctcattgctgtaatttatcttgctgctatcttcgtaccgagcatctgggatgcgttccaattcactggcgccacagctgctgtgcttattggtttcatctttcctgccatgattatactcagggatccatatggtgtttccaccaagcgtgacaaggttttggcggtaacaatgattgtgcttgctgtggtgtccaattctgtggccctgtacagcgatgcgctcaacatcttctacaggaagcaggaggcctagagtccatcatacctcaggggaaaagttctttatacaggtctagagtgattgttgacctttttaagctactactgagcagcagtgccacgagatttcatggtggtcaatattttttgtttggtcacttgaaagaaacctggtttgttgcaaatatttgttagtcttctgaacataaaccgcctccacatctggatggcccacttgtgctatgatcacctgtggaacattttttttttcacgtggttgttcattcagtcatcttgtaatggatgactaaaaatgctgtatatatataacggatagttccctgcttttgtgtt

SEQ ID NO: 89 - DNA, 1606 bp, Hordeum vulgare
ccagcatcaagatgctgggcctcattcctggccttctgatgatcgtctttgtggcattgctcacagaggcgtccattgacatgcttatcaggtgcagccaccaaggaaagatcacgtcatatgggtggctgatgggtgaggcatacggacaatggggaaggattgcgttgcaggcttctgtggttataaacaacatcggtgtgatgattgtttacatgattatcattggcgatgtattatctggaacgtcatcaggcggtgttcatcatcgtggcatattggagggctggtttggagcacatttgtggaattctcgtgccattgttcttcttgtgacaactctttttgtgtttgctccgttagtgagctttaaacgactggattcattgagctacacatctgcactatcagttgctctcgctgtgatttttgttgttattactgctgggattgccataatcaaagtcttcaatggaactgtagcaatgcccaagctttttccagaaatagacagtcttagttctgtctggaagctttttacagctgtacctgtccttgtcactgcctacatctgccactataacgttcacagcattgacaatgagcttgaggataaaacacaaactaaaccaattgtgcgaacatcgctggcactttgctccagtgtttacattgccacaagtttctttgcttatcttctctttggagagggtacactggatgatgtgctcgccaactttgattcaaatcttggcattccgttcagctctgtctttaatgacatagtcagagtgagctatgccgcccacgtcatgcttgtcttcccaatcgtcttctttgcccttaggctcaacttggatgggctactctttcccacgtcgaggcacatttctcatgacaataagagatttacaatcataaccatctcactccttgtggttatttatactgctgccatcttcataccaagcatttgggatgcatttcagtttactggtgccacagctgccgtcttgatcggttttatctttcctgcgatggtcatattaagggatccgtatggaatcgcaaccaagcgcgacaagatcttggctgtaaccatgattgtgcttgctgttgtctcaaactctgttgccctatacagtgacgcaatgaacatcttccgtcggaaagaggtagcctaaatttcagacttcgaagttcaaaggaagggtgtcactgatgaggaagcacagtttcatattacaaaattcagtggctttggaggaagatggtttgctgggatgctgtaaagcaagatgattgcttggtcagcaactcagcattgagacctgtcacatggaagaattggatggttgaaattgtcaggtcttgtgtatataagctggctcaacgtcgaattgagccacttgcaatatatgtatgttctttttttggcgcgaatatatgtgcccaccccagatagaaaagaaagcattgctgcagaaaagcttgctctagaattatgtacagtgttcctagtatttgagttgagttaaatatgtttcattcgaacctaaacttgaggttccgaataaaaatgaagtggccattgttaccatccaaa

SEQ ID NO: 90 - DNA, 1847 bp, Hordeum vulgare  2
gagaaggcccgggagtgggtgggtgggagaactccgtctgcacaccacgcgcgctcgcacgaaattctcctcgccgattcaagccttctgctctgctctcttcgtgttcgggttgttgttggccgagcgacagttgggattctgtggaggaggttggaagtactactctaacaaatggggattggggatggctcacctagtgaaacccagcatgcggcacacaaggaaaagagggatgagaccacgccacttctcccactcaaggcggaagaggaagacgggatccatgagttcaatggagcttctttctcgggtgcagttttcaatctgtcgacaaccatcgtgggggctggaattatggccctgccagcaagtatcaagatgctaggcattatccctggtattttgatgatcatccttgtggcattgctcaccgaggcatcgattgacatgatggtcaggtgcagccaccaggccaagattacatcctatggctggctgatgggtgactcttttggtcaatgggggaggattgcgctgcaagcatctgtggtgataaacaacattggtgtcatgattgtatacatgattatcatcggtgatgtgctatcaggaacatctacaactggtgttcatcaccggggtatctttgaggggtggtttgggcctcatttgtggaattctcgtccagttgttctccttgccacaactatttttgtgtttgctccattggtgagctttaagcgattggattcattgagatacacatctgctctgtcagttgctcttgccgtggtttttgttgtcatcactgctggaattgctattctcagactgatagaaggaaccgcggagattcccaaactcttccccgagatacatgaaatcaattccatctgggaactctttacagccgtgccggttcttgtcactgcctatatttgccactacaatgttcacagcatcgataacgagctggaagatagaagtcagactaagccaattgtgcgaacttcactggctttgtgttcaaagtgtttatgttgccacaagtttctttgcatatctcctcttttggcgaggctaccctctccgatgtgctcgctaattttgactccgaccttcatattccattcagctctgtcttcaatgatatagtcagagtgagctatgtagtccatgtcatgcttgtcttccctatagtcttctttgcccttaggctcaacctggatggactcctcttccccacctcaaggcacatttctcatgacaaccgaaggtttaccattatcaccgtctcgctccttgttgtgatttatcttgctgccaacttcataccaagcatctgggacgccttccagttcactggtgctacagctgctgtcctgattggtttcatctttcctgccatgatcatactcagggattcttatgggatcgcaaccaagcgcgataaggttttagctgtaaccatgattgtgcttgctgtgctctccaattcagtggccctgtacagtgatgcgatgagcatcttctacaggaaggtggaggcctagtctgctccatgcctccatactccaagggaataagtccaataaacatgcacaattcggaatgattattgagctttagctagtatattgcacagtcaagcaatgtgatttcatggtgtccattaatttttgttttggacacttgaaaggattttgtttgctgcatttgtcttgtaagccggctcagcatctagatgagcaatttgtgattgggtcgcaggtgtttctatttattgccaagaacgagatttttattcttttgggggttatgtacatgttcatattcgatcgtct

SEQ ID NO: 91 - DNA, 1344 bp, Triticum aestivum 1
catcatcgtggcatattggagggctggcttggagcacatttgtggaattctcgcgccattgttcttcttgtgacaactcttttcgtgtttgctccattggtgagctttaaacgatttggattcactgagctacacatctgccctatcagttgctctcgctgtggtttttgttgttattactgctgggattgccataatcaaagtcatcaatggaactgtagcaatgcccaagctttttccagaaatagatgatcttagttctgtctggaagctttttacggctgtccctgtccttgtcactgcatatatctgccactataatgttcacagcattgacaatgagcttgaggataaaacacaaactaaaccaattgtgcgaacatcactggccctttgctccagtgtttacattgccacaagtttctttgcttatcttctctttggagatggtacactggatgatgtgctcgccaactttgattcaaatctcggcattcctttcagctctgtcttcaatgacgtagtcagagtgagctatgctgcgcacgtcatgcttgtcttccccatcgtcttctttgcccttaggctcaacttggatgggctactctttcccacgtcgaggcacatttcttatgacaataagagatttacaatcataaccatctcgctcctcgtggttatttatactgctgccatcttcataccaagcatttgggatgcattccagtttactggtgccacagctgccgttttgattggttttatctttcctgccatggtcatattaagggatccttatggaatcgcaaccaagcgtgacaagatcttggctgtaaccatgatcgtgcttgctgttgtctcaaactctgttgccctatacagtgatgcgatgaacatcttccgtaggaaagaggtagcctgaacttcagagttcaaagttgaaaggaagggtgtcactgatgtaggaagcgcagtttcatattacaaaattcagtggctttgaaggaagatggtttgctgggatgctgtgaagaaagatgatttctttggtcagcaactcagcattgaggcctgccacatggaagaattggatggttgaaattgtcaggtcttgtgtacatgagctggctcaacgtcgaattgagccacttgcaatatatgtatgttctttttttggcgcgaatatatgtgcccaccccagacagaaaagaaagcattgctgcaaaaagcttgctctacaataatgtacagtgttcctagtatttgagttgagttaattctatgttttatttggacctaaatccaaggtttcgaatacaaataaagtggccattgttaccatcc

SEQ ID NO: 92 - DNA, 1359 bp, Triticum aestivum 2
  misc_feature (1282)..(1282): n is a, c, g, or t
  misc_feature (1320)..(1320): n is a, c, g, or t
  misc_feature (1352)..(1352): n is a, c, g, or t
gcggggagggacaactccgtctacacgcgcgcgcacccgccaaagtcttctcccgcgattttcttcgtctccgctctcttcgtgttcgggttgttggccgagcgactgttgggattctgtagaggtgatgtgctatcaggaacatctacaactggtgttcatcaccggggtatctttgaggggtggtttggtcctcatttgtggaattctcgtccagttgttctccttgccacaactatttttgtgtttgctccattggtgagctttaagcgattggattcattgagatacacatctgctctttcagttgcccttgctgtggtttttgttgtcatcactgctggaattgctattctcagactgatagaagggaccgcggagattcccaaactcttccctgagatacatgaaatcaattccatctgggaactctttacagctgtgccggttcttgtcactgcctacatttgccactacaatgttcacagcattgataacgagctggaagatagaagtcagactaagccaattgtgcgaacttcattggctctctgttcaagtgtttatgttgcaacaagcttctttgcatatttactcttcggcgagggtaccctctccgatgtgctcgctaattttgactctgaccttcatattccattcagctctgtcttcaatgatatagtcagagtgagctatgtagtccatgtcatgctggtcttccctatagtcttctttgcccttaggctcaacctggatggactcctcttccccacctcaaggcacatttctcatgacaaccgaaggtttatcattatcaccgtctcactcctcgctgtgatttatcttgctgccaacttcataccaagcatctgggatgcgttccagttcaccggtgctacagctgctgtcctgattggtttcatctttcctgccatgatcatactgagggattcttatgggattgcaaccaagcgcgacaaggttttagctgtaaccatgattgtgcttgctgtgctctccaattcagtggccctgtacagcgatgcgatgagcatcttctacaggaaggtggaggcctagtctgctccatgcctccatactccaagggaataagtccaatgcacatgcacaattcggagtgattattgagctttagttagtatattgcgcagtcaagcaatgtgatttcatggtggccactaatttttgttttggacacttgagaggattttgtttgctgcatttgtctagttccttgaacatgtaatccggctcagcatcnagatgagcatttgtattggcgaggttttttttttttgncaagaacaagattttattactttgggggtcanaaaaaaa

SEQ ID NO: 93 - DNA, 2037 bp, Zea mays
gcgcagcagcacggcagtcctccgtttcctcctcgtcgctcgccccggttgtctcctcctcgacctcccccgtcgcgacaccgcccgatctctctagcgcacggcggacggagaagaggaggagggggggacgatctcattcatcggaccggcgtgcctgtgtcgtctgctgttttcgttattttttctttactctttttttttcttcctcctttgcttgttcaattcaatcagtataataagatttctgatttgggggcggctcgccatgggattcggaatggggaataataacaacggggcgagctcctcgtcgtcgaggctggacccggcggcgccgctgctgccgcgccacggcagcagcgggggccgcgagggtggtggcctgtcgtcgcagcccaagacgttcgccaacgtcttcatcgcggtggtcggcgccggcgtgctggggctgccgtacaccttctcgcgcaccgggtgggcggcgggctcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcatgggcggttcgccgtggacgtgatgctggtgctcagccaattcagcttctgcgtcggctacctcatcttcatctccaacaccatggcgcacctctatccgattaccgccgcggcctcgtcctcctccgcgctcctctcccccaaggcgctcgtcatctgggcgatgctgcctttccagctggggctcaactccatcaagacgctgacgctgctcgcgccgctcagcatcttcgccgacgtcgtcgacctcggcgccatgggcgtggtcctcggccaggacgtcgccgcctggctcgccaagcccgtgcccgtggtcgccttcggcggcgcaggcgcgcttctctacgggctcggcgtctccgtgtacgcgttcgagggcatcggcatggtgctgccgctggaggcagaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatcttccaatcgtcaagcgcttgatcgacgcgcgttccgctgcgcgtcgatcatcgcattctccagggcaactacgatacatgtgttgagtgttgttcgtgagtggcttgtattggacgggggaaatctgtacgcttttcgtaccacagatttcagttactcccggtagcagtgtatgtgtatgcgtcctagatgttcctcctgctgtgcacgatgggggatacgatgaaaggacaagattttcacttcgtggaaaaagcttattttgctgttaagtgccaacgtacttcatgcatccagtgctaatttcaattgtgaattggccccttggcccttcgagacaggccaagcagctaggacaaacggatcaattcgagtttgtacgctcgtaatttcggttcccttttcatttggaaggccaatttggatacgcaactgggacaagttgtatcaccacttgtcaaggtgtactcaattcagttccccagaataaa

SEQ ID NO: 94 - DNA, 1411 bp, Zea mays
attgtgttgggagaggaactacacctacatggacgctgttgccgcgtacctgggtcgatggcaagtcctgtcctgtggtgttttccagtatgttaacttggttggaactgccgttgggtatacaattacagcgtccatcagtgcagcggccgtgcacaaggcaaactgcttccacaacaagggccacgcggccgactgcagcacctacgacaccatgtacatggtcgtatttgggatcgttcagatcttcttctctcagctccctaacttcagcgacctttcgtggctgtccatcgtcgccgccatcatgtcgttctcttactccagcatcgccgtcggcctctcgttggcgcggaccatttcaggccgtagtggtacgaccactctgaccggcactgagatcggagtcgacgttgattcagcccagaaggtctggctcgcgcttcaagctcttggcaacatcgcgttcgcttactcctactccatgattctcatcgaaatccaagacacggtgaagtctcctccagccgagaacaagacgatgaagaaggcgacgctgatgggcgtgacgaccaccacggcgttctacatgcttgctggctgcctcgggtactcggcattcgggaacgcggcgccagggaacatcctgaccgggttcggcttctacgagccctactggctgatcgacttcgccaacgtctgcatcgtggtgcacctggtgggcgcgtaccaggtcttctcccagcccatcttcgcggccttggagacggcggccgccaagcgctggccgaacgccaggttcgtcacgcgcgagcaccccctcgtggccggcaggttccacgtcaacctgctcaggctgacgtggaggacggcgttcgtggtggtgagcacggtgctcgccatcgtgttgcccttcttcaacgatatcctgggcttcctcggcgccatcggcttctggccgctcaccgtgtactacccagtggagatgtacatccggcagcggcgtatacagaagtacaccagcaggtgggtggcgctgcagctgctcagcttcctgtgcttcctggtgtcgctcgcctcggcggtcgcgtccatcgagggagtcaccgagtcgctcaaacactatgttccctttaagaccaagtcgtgatgactgactgagcttcaattctccggtccctgtacaatgcaatggcctaccaccttgcagtggtcgctaagggttatatagtccacatgaaaaactgatgtacatagaaaatcctgaccttcaaaaacagatttggtgtgtgattgttttgcaccgttatatctgattttgaagactaggattttatatgtgtacgtgtataccaaactttcatgtgtaccaaataccatgggctaatgaaaaactgatacaattgagtcc

SEQ ID NO: 95 - DNA, 949 bp, Sorghum bicolor
ggacacggtgaagtctcctcccgccgagaacaagacgatgaagaaggcgaccctgatgggcgtgacgaccaccacggcgttctacatgcttgctggctgccttgggtactcggcgttcgggaacgcggcgccagggaacatcctgaccgggttcggcttctacgaaccttactggctgatcgactttgccaacgtctgcatcgtggtgcacctggtgggcgcgtaccaggtcttctcgcagcccatctttgcggccttggagacggccgccgccaagcgctggccgaacgccaagttcgtcacgcgcgagcaccccctcgtggccggcaggttcaacgtcaacatgctcaggctgacgtggaggacggcgttcgtggtggtgagcacggtgctcgccatcgtgatgcccttcttcaacgacatcctgggcttcctcggcgccatcgggttctggccgctcaccgtgtactacccagtggagatgtacatccggcagcggcggatacagaagtacaccaccaggtgggtggcgctgcagctgctcagcttcctgtgcttcctggtgtcgctcgcctcggcggtcgcgtccattgagggagtcaccgaatcgctcaaacactatgttcccttcaagaccaagtcatgatgactgatgactgagcttctgcgtgtacaatgcaatggcctaccacacaccttgcaatgctcactcagggtcagatgtttaacagtcgcctttgttgtgccatagctcagggtaggagaggttcagtcattatggatggatgcataatgttatctccggttgtgtagagaggtttcgatggcgtcttggatatgttgtaaagtgtgcagaagcttgagctgatgatgtaggaatcgaattgttacaagcttttgctcaaattaaaatgaattaaaaggtaatgcagccaacgcaaaccgaatt

SEQ ID NO: 96 - DNA, 2019 bp, Oryza sativa
ggcatcgcatcctctccccacacaatccccacccggcctagcgagcgagagagagggaagggttgcgacttgcgactcgcgagcggcgagatggcgaaggacgtggagatggcggtgcggaacggagacggcggcggcggcggcggctactacgccacccacccgcacggcggcgccggcggcgaggacgtcgacgacgacggcaagcagcggcgaaccggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtggctggcaagtctggtcctgtggtgttttccaatatgtcaacctggttgggacagcaattgggtacacaatcacagcatccatcagcgcagcggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgctactggtaagactactctgactggcgttgaggttggagttgacgtcacttcagcccagaagatctggctcgcgttccaagcgctcggtgacatcgcgttcgcctactcctactccatgatccttatagaaattcaggacacggtgaagtctccaccggcggagaacaagacgatgaagaaggcaacgctgctggggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgtaatgaatcggaatgtttaacaaacaaggcttgttctgaactcttctcagggacaggcatggataacagattaaagataaatgaatgtgttagacaagggcagattagaagcggctcttaagcttcacacaatggttttttctctttcttttattaatgaaaccaaagcagttgaacaattgagcaatatgattaatgagaaacgactggaggtctcactcctctttatg

SEQ ID NO: 97 - DNA, 1747 bp, Triticum aestivum
  misc_feature (1719)..(1719): n is a, c, g, or t
cggaaaccatatatgccagccggtttgggcaactgggccgattccatccaagaagaattaaaggagtaactcgctgcgttataagaccgccgggcgcatcgatcgctagctagctgttcgcacgcagagcaccagtccagcgtaggcgatggcccgggtaggcggcggcgatgtcgagatcggggggcttccggcgccggcgggcgaccctcggcggagggtcgtcgccgccgacgactccctcgacgacgacggcaagcccaggcggacagggacggtgtggacggcgagcgcgcacgtgatcacggcggtgatcggctccggcgtgctgtcgctgccctggtccgtggcgcacctgggctgggtcgccggcccggtcacgctcctgctcttcgccatcatcacctactacacctccgtgctcctcggcgactgctaccgcagcgaggacgccgtcaccggcaagaggaactacacctacatggaggccgtcgggtccctcctaggtaaagggcaggtgtggttttgcggcctctgtcagtacgtcaatctgattgggactgcgatcgggtacaccattacagcatccatcagtgccgcggctttgtacaaggccaactgcttccacagcaaaggccactcggccgactgcggggtgtacaccaccatgtacatggtcgtgttcgggatctcccagatcgtcttctcccagctccccactctccacgagatggcctggctgtccatcctcgccgccgtcatgtccttctcctacgccaccatcgggcgtcggcctctccttggcacagaccataacaggtcctacggggcaagacaaccatcggcggcactcaaattggggtggacgtcacttcggcccagaagatatggctgacattgcaagcgctcggcaacatcgccttcgcctactcatactccatggttcttatagaaattcaggacacggtgaaggcgccgccggccgaaaacaagacgatgaggaaggcgaacctgatgggggtctccaccaccacggccttctacatgctctgcgggtgcctcggctactcggccttcggcaacgacgcgccggggaacatgctcaccggcttcggcttctacgagccctactggctcatcgacttcgccaacgtgtgcatcgtggtgcacctcgtcggcgcctaccaggtgtactgccagcccatctacgccgccgtggagagctgggcggcggggcggtggccaaactcggagttcgtcgtccggcagtaccaccccttctcgggcaagttcagcctcaacatgttccggctggtgtggaggacggcgttcgtgatcgtgagcacggtgctggccatctcgctgccattcttcaacgacatcctcggcctgctcggcgcgctcggcttctggccgctcaccgtctacttccccgtggagatgtacatctcgcagagcaagatgaagaagtactccaggaagtgggtggcgctgcagaccctgagcttcgcgtgcttcgtggtcaccgtcgccgtcaccgtcgcctccatccaggggatcacccagtcgctcaagaactatgtgccgttcaagaccaagttgtgaaatggattagcttagctgtgagtagaaattctttgacttggtgtttgtttaagttttttctcgagaaaaaggtgtcatctgtagactgtatctgtgtgcttgatgtttttaganaatggaaatccaaggaggtaggactata

SEQ ID NO: 98 - DNA, 1494 bp, Zea mays
ccacgcgtccgtcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgtgctggctgaccccgccgagaagccgcgcgccgccaaggctcaggtggtgggatggccaccggtccggtcgttccggaagaacatcatgtccgtgcagtccgacaagggcgccggcaaagacgccgccgccgccaacggcgacaagtcctcggcggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttc

SEQ ID NO: 99 - DNA, 1517 bp, Sorghum bicolor
tggatccccttgcatttgcatttgcctcctcctttacatttgcaaagccagccggcctcctcgtcctggctcgcaagcaaagcaaagcaaacgaagcagaagcagggaagaagaagaaggcgagagccgagaggtgaggagctaggccagtggcgcctgcagcagcaatggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaagccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggagctgtccaaggcgctcgagaagatgttcagctccttcaccattggaagctgtgggtctcaagggatgaacggcatgaacgagagcaagctggtggatctgctcaacggctccgagtacgtgccgacctacgaggacaaggacggcgactggatgctcgtcggcgacgtgccgtgggagatgttcgtcgagtcatgcaagcgccttcggatcatgaaaggatcagaagccattggcctcgcaccaagggccatggagaaatgcaagaacagaagctgaggagaagattgaaagcttgcattgcatctgaacaccatggatgggtgcaagaagaaccaatctccatagcttttgcagctctgctcgcctctgtatcatatcgtccctgctctccaactccaagcctctatatctcctgatcaatgaagtcattttggtgtgtcaactgttctatcatatctgtgccagtttgtcagtaaacgagtcgatcactcagtgttcaagtctcatcttgtcctatactacagaagagaagccatgaacatgtacctgtcctataacaatgtctttttgcactacctgttctctcctcctcttctttttttttggtggctcaaaatgcaaaggcaccctgctcctaatcaaggggcccttttgcatcttgtccatcaaaagttgtttaattataattaccacggtgtgtcagtggaacaaataactgtttcaagctgttaaaaaaagttgtgttgtaatatgatcatcgctctccctctcttcctgttt

SEQ ID NO: 100 - DNA, 1567 bp, Oryza sativa
  misc_feature (15)..(15): n is a, c, g, or t
  misc_feature (31)..(31): n is a, c, g, or t
accgggcctcacacntagatggtcggatccncacgcgtccgagccaaccctctcatcatcaccatcaagctcaaaccaacaagaagagagctagcttttggtactattagccactagtagatagccaagaagaaaccaagaaattctttgagctatctaattagctaggtccattgattcatcatcatctccattgatccacttagctttgaagaagaagaagaagaagacatttagttagctagctatattgaggtgaggtggcggcggcaatggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgcctagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccggcgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaacaatctatctatagcttttcttaattgcagctttgcctcatccctgtatcatactcgcttgctgtcctcatctccaagtctgtacctttcctgatcagtgaaagtcattttggtgttgtggtcagtttctgttctgttgcagtcattaagttcctaagtgtgtcatcttgtcttatacataagaaagaagccaagaacatgtaccagtagtacctgtcccataattatgtcttttttgctctccctgttcttccctttctctctgttttttttttaccttaatggcacaaaatgtaaaggcaccctgctcaaagggacctcaatgtattttgtccatgaaaaggttgtttaattatcttcatggtgtatccatcaaacaaaaagttattcatgcaagggtgttatgtgtt

SEQ ID NO: 101 - DNA, 1675 bp, Zea mays
  misc_feature (653)..(653): n is a, c, g, or t
cgggctgccatcaacgccagatcctagcccgccattaatgccgttaacccgagctcgagatcggaggcggcggccccgtgttcgcgccaggagtggccaccgtacgtgtgacacgcgccgccgccgtttataaaagcacaccgccgctcgctcgctcgcccgcccgcccgccaccactcactcggctcgggttctgctctgcacctcagtacctcacactgtcaccgcgcttctgtgacctgacgaccttcggcggcaggatgctcacgtgcatcgcgtgctccaagcagcagttcgccggcggcggcccgccgctgcacgaaccgccggaggacgacgatgtagttgacggaggaggcggcggcacggcgacgcccagaacacggcacgccatcaaggcgctgactgcccagatcaaggacatggccctcaaagcgtcgggcgcgtacaggcactgcaagccctgcgcaggctcctcggcggcggcctcgcggcggcaccacccgtaccaccaccgcggcggcagcgccttcgggggctccgacgccggctcggcctccgaccgcttccactacgcgtaccgtcgcgcgggcagctcggcggacgccacgacgtccatgagcgtgcgcacggacttccctgccggcgacggngaggacgacgaggtggcgtcagaagccgctggcggatgcggtggcaaggacgacgacgccaaggagtgggtggcgcaggtggagccccgcgtgctcattaccttcgtctcactggcgcaaggtggcaacgatctaaaacgcattcgattcagccgtgagatgttcaacaaatgggaagcacaaagatggtgggctgaaaactatgacaaagttatggaactttacaatgtgcagaagtttaatcaaactgtccctctcccagctaccccaaaatctgaagatgagagctccaaggaggacagcccggtgacaccaccactggacaaggaaaggctaccccgcactttccacagacaaggtggtggagcgatgggctcctcttcatcagattctctcgagcatcactcaaaccactactgtactggccgccaccaccaccaccaccaccatggacaccaatgctgtgattcaatgggcctggcatcaacgccaaagctgtcaagtatcagtggagccaaaacagaaacctcatcgatggacgcgtcaatgaggacaagctcgtcaccctgaggagatcgacaggtctggtgagctctcggtgtccgtcagcaatgcgagcgaccaggagagggagtgggtcgaagaagacgagccaggcgtatatatcacaatccgggctttacctggtgggatcagagagcttcgccgcgttcggttcagccgggagaagttcagcgagatgcatgccaggctgtggtgggaagagaaccgagcgaggatacacgaacaatacctctgagaagagacgcccgacaccatcagcagcacgagcacatgaatagagctggcactaacacatccacatgcatttccagcttcatacgatgttttgctaacctaagaggtccggtttccggtattttacatttcgttcagtctcacgtgtggtggtggtggggtgggaggatagtgtacgtatttcacagtttcactactgaatctgtaggtctcgtttttcatca

SEQ ID NO: 102 - DNA, 1741 bp, Zea mays
ggcacgagtctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctgacgacaaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaaggaagactttcagaagtatcacgcatctgccatagatgtgcctggtccagaagtgtcctgcttgtctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggacgatgactatgtgcagacctaatgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattaaaaacgt

SEQ ID NO: 103 - DNA, 1779 bp, Zea mays
ctgccacatacagcctcgtttgagctctagactcgagagaggcggatagggagaggcagcaccgcagggagcagtgacagagaggccgagcgagagagagagatggacgtggagaggaaggtggtggaggcggacgacgacggccgcgtcagaacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctacttcaccgccgtcctcctgtccgactgctaccgcacgccggaccccgtccacggcaaacggaaccgcacctacatggacgtcgtccgctcatgcctcgggcctagagatgtggtggtgtgtggactcgcacagtacgcgatcctctgggggacaatggtgggctacaccatcaccactgccacgagcatcatggccgtcgcgcgcacggactgccgccaccacaggggccacgacgcggcctgcgcctcgtccgggacggtgtacatggtggcgttcggcgtcgtcgaggtggtcctgtcccagttcccgagcctggagaagctcacgatcatctccgtggtcgctgccgtcatgtcgtgcacctactccttcgtcgggctgttcctgagcgccgccaagctcgcgtcgaaccacggggcgcgcggcagcctcctcggcgtcaagatcgccgcgggcgtctccgcgtcgaccaagacgtggcactcactgcaggcactcggcaacgttgccttcgcgtacacctactccatgcttctcatagaaatccaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgcccggcagccgcaagtgggtggcgctgcaggcgctcaatgtgggcgcgctcctggtttcgctgctcgccgccgtgggctccgtggccgacatggtgcagcgcctgggccatgtcaccatctttcagacgcagctctgaaacaagtattcagatcttatgcatgggaacgcgcttgcagaggcatacatcatacacatgcttgtgccgtatattcacctgtgatcttagtacattggttttggaagaacaactaaaaatggagcatgtaagtcattccacctagatttcgtgcattgcaagagtgctttttggggtgaaatagcagacagtgcacactccatgacacatttgaagcccagctaagcgttgggctgaattaatgaatatgtttcttcaagggaaaaatagcacttcacatttttactcttt

SEQ ID NO: 104 - DNA, 1288 bp, Zea mays
  misc_feature (69)..(69): n is a, c, g, or t
  misc_feature (323)..(323): n is a, c, g, or t
  misc_feature (372)..(372): n is a, c, g, or t
  misc_feature (558)..(558): n is a, c, g, or t
  misc_feature (585)..(585): n is a, c, g, or t
  misc_feature (598)..(598): n is a, c, g, or t
  misc_feature (613)..(613): n is a, c, g, or t
  misc_feature (624)..(624): n is a, c, g, or t
  misc_feature (632)..(632): n is a, c, g, or t
  misc_feature (673)..(673): n is a, c, g, or t
  misc_feature (923)..(923): n is a, c, g, or t
  misc_feature (993)..(993): n is a, c, g, or t
  misc_feature (1014)..(1014): n is a, c, g, or t
  misc_feature (1149)..(1149): n is a, c, g, or t
  misc_feature (1155)..(1155): n is a, c, g, or t
  misc_feature (1165)..(1165): n is a, c, g, or t
  misc_feature (1192)..(1192): n is a, c, g, or t
  misc_feature (1218)..(1218): n is a, c, g, or t
  misc_feature (1244)..(1244): n is a, c, g, or t
  misc_feature (1255)..(1255): n is a, c, g, or t
gatcgcgcactggggtgggtggccggccccgccgccatgctgctcttcgccttcgtcacctactacacngccacgctgctcgccgagtgctaccgcacggggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacncctacatgatcctcttcggcgccgtccagatcctcttctcccagatacnggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacacctgcaggcnttcggcgacatcgcgttcgcctactcnttctccaacatcntcatcgagatccaanacacgatcaangcgccgcnccgtcggagtcgaaggtgatgcagaaggcgacgcggctgancgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcgcctggcccgacagcgccttcgtctcgcgggacnccgcgtgggggcccctcgccctcagcgtgttccgcctcacgtggcggtcggcgttcgtgtgcgtcaccancgtcgtggccatgctgctccncttcttcggcaacgtggtggggttcctcggcgccgtctccttctggcccctcaccgtctacttccccgtcgagatgtacatcaagcagcgccgcgtgccccgcggcagcaccaagtgggtctgcctccagacgcncagcgngcgttgcctngtcgtctccatcgccgctgccgccggntccatcgccgacgtcatcgaggcgcncaaggtttaccacccgttcagcagtnaattcttgctnctgtggatgtcctgggtggggcctggcctggcc

SEQ ID NO: 105 - DNA, 1308 bp, Arabidopsis thaliana
atgacaccacagatcaaaactcatctcttgccgaagcaagaaccttcttcgtctgagaaccatggatcatcaacctccggcatcgttttcaacgtgtcaacgagtataatcggagccggaataatgtcgatgccggcggcgtttaaagttcttggaatagttccagcgtttttgattatcacgatcatagcttggctttccacaatttccgttggatttctgatgaaatcaactctcgccggagaatcaactacttacgccggagttatgaaagagtcgtttggtaaaacaggatccatcgctgtacagattgctacgatggttgctacttttggttgtatgattatattttcgattattataggagatgtgctttctggtaatgaaaatggtggtcctgaacatattggagttttgcaagaatggtttggttcttactggtggaacacgagaatcttcgctttgttatttgtctacggctttgtcttgcttccattggtcctgcgtagacgagtcgaaagactggcaattagttccgctgtatcgtttcttcttgcggttctatttgttgtcataagctcggtgctggcgatttccgcgctggtgaatggacaaacgaagaatccaagactgtttccggagttgagcaatggaggatcgttctggcaactcttcacagcttcccctgttatagttacagccttcacgtttcacttcaatgttcatccaattggattcgagctcaaagatccattacaagtgatcccagcaactaagatctctgtcatcttgtgtgctgctatctacttcgcaactggactctttggttaccttctctttggagatgcaactatgtcggatattctagtgaactttgaccagagctctggttcttccattggttctcttctcaacgacattgtcagactcagctacgtgcttcacctcatgctggtctttcctctcctgaacttctcattgagagcaaatctcgacgaactcttgtaccccaagaagccgtccttggaaaaagacacaaaaagattcatcggactcactctggctctactgatttgctgtttcttgtctgcaatcgctgtaccagacatttggtacttctttcagttcatgggatcaaccatcacagtctccatagcattcatatttccagccgccattgttctaaggaatatccatggtgtatcaacctcaagagagaagatcgtagctgcaataatgcttgttcttgctgttgccactagcattattgctatctcgacaaatttatacagcctcgcagcaaactag

SEQ ID NO: 106 - DNA, 1284 bp, Arabidopsis thaliana
atgaggtacgatcaggaagcgggatcgtcctcccattcgctgccttcgggatcatcctcccattcgctgccgccgacggaagacactcctcttttggggcctcgaacattgtcgtcgcagccaaaaacctttgcaaatgtcttcatcgccatcgtcggcgccggcgtgctcggacttccgtacaccttcaagaagactggatggctcttgggcctcctcacactcctcttcgtatcctccctcaccttcttctgtatgatgctcctcgtccacacccgccggaaactcgagtccctctccggcttcaacagcatcacttctttcggagatctcggcgaatccgtctgcggccctgccggtcgtctcgtcgtcgatgttatgcttgtcctttcccaatctggcttctgcgtcagttaccttatcttcgtcgccaccacaatggctaatctcctcagccgcggcaccgaacatattctaggcctcgatgctgcttccatttacctctggggatgtttcccctttcagctgggtctcaactccatcccatcgctcacccatctcgcccctttgagtatattcgccgatatcgtggacgtagccgccaccttagtggttatggtgcaggatgttttcatcttcctgaaacgaagacctcctttgagagtctttggaggtgtctctgttttcttctacggattgggagttgcggtgtacgcatttgaagggatcggaatggttctgccactggaactagaggctaaatacaaagacaagttcggtagagcgctggggctagccatgggcttaatctcgatcatgtacggtgcgttcgggctgctagggtacatggcttacggagaggagacgaaagacatcatcaccaccaacctggggacaggagtggtgagcactctggtgcagctgggcttagcaatcaacctcttcttcacattcccccttatgatgcaacctgtctacgaggtcgtggaacgccgcctttgcagctcccgttactctgtatgggtgcgctgggccactgtgctggtggtcacgctcgtggccctgctcgtcccaaattttgcagacttcttatctctggtggggagcagcgtctgcgtggtgctgggctttgtcttgccatcactatttcacttgcaggctttcaaaaacgagttgagcatcacaagaatagtggtagacgttctcgttttcctcattggtgttatgatagccattaccgggacctggactgcagtacatgagatcctgacatccaaggcctga

SEQ ID NO: 107 - DNA, 1770 bp, Arabidopsis thaliana
atggatcaaaaagttagacagtttgaggtttgcactcaagacggtagcgttgatcgtcacggcaatccagctatccgagctaataccggcaaatggctcactgctattctcattctagtgaatcaaggactagctacgcttgcgttcttcggtgtaggagtgaatttggttctgtttctgactcgagtgatgggacaagacaatgcagaagcggctaataatgttagtaaatggacaggaactgtctatatcttctctttgcttggtgctttcctcagtgactcttattggggacgttacaagacttgtgctatctttcaagcaagtttcgttgcagggttgatgatgttatctttatctactggtgcgttattgcttgaaccaagtggttgtggagttgaagattcgccgtgtaagcctcattcgacgtttaagacggttctgttttatctgtcggtgtatctaatcgcgttagggtatggtggttatcagccgaacatagctacttttggagctgatcagtttgatgcggaggattccgttgaaggacactcgaaaatcgcgtttttcagttacttttacttggctctgaatcttggatcgctcttctcaaatactgtcttgggttactttgaggatcaaggggaatggccgcttggattttgggcgtctgctggctctgcttttgcggggttagtgcttttcttgattggcacgccaaagtaccgacactttacgcctagagagagtccttggtctagattctgccaagtgttggttgctgcaacaagaaaggctaagattgatgtgcaccatgaagagttgaatctctatgattctgagactcaatacactggagataagaagattcttcataccaaaggcttcagattcttggatagagctgctattgttacacctgatgatgaggctgagaaagtagagagcggatcgaaatacgatccatggaggctctgctcggtgactcaagtcgaagaagtgaaatgtgtattaagactcttaccaatctggctctgcaccatcctctactctgtggttttcacccaaatggcttcactgttcgttgtgcaaggagcagcgatgaagacaaacatcaaaaacttccggattccagcttcaagcatgtctagtttcgacattctcagtgtcgccttcttcatcttcgcatacaggcggtttcttgatccactctttgcaagacttaacaaaacagaacgcaacaaaggtctcactgagcttcagaggatggggattgggcttgtgattgcgataatggcgatgatttccgcaggaatcgtagagatacacagactgaaaaataaggaaccggaaagtgctacttcgatctcaagctccagcactttgagcattttttggcaagtacctcagtacatgttgataggtgcatcagaagtgttcatgtacgttggtcaactcgagttcttcaacagccaagcaccaaccgggctaaagagctttgcaagcgcgctatgtatggcttcaatatctcttgggaactatgtaagcagtttgttagtttccattgtcatgaagatctctacaacagatgatgtgcatggctggattcctgaaaatctcaacaaaggacacttggagagattctacttccttttagctggtctaaccgctgctgatttcgtggtttacttgatttgtgccaaatggtacaagtatattaaatctgaagcaagtttctctgagtccgtaactgaagaggaggaagtctga

SEQ ID NO: 108 - DNA, 1611 bp, Arabidopsis thaliana
atggaggacaagaacaatgataaggagaaaaaaaccgacgttacgttcgaagatgacgaagataacgaagatctagaagacaacagcagtaagtacgagaacgacagtgaaactgatcaaagcgatctcggagatcttcctggtgatgctgttgatcgtgacgacgacatcgatgaacctttcatttcccaggttcaatggcctcaaagcttcagggaaacgactgattcttatacgattgcggcatcaccaatcttcgggtcgctcaggagtaatcctccgagtttctatagagccagcagaagtaatttagatgttgagtcaaaagcacctttgcttcctgagaggcatgatgattcagacaaagcctcagctacacaatctgcttggtctcataaaggctcatttgctgaggaattgcccattggtggctatggatgcagcgtcattcaaaccattttcaatgctattaatgtaatggctggagttggacttctctcaacaccttatacagtgaaagaagctggttgggcaagtatggtaattcttctcttatttgctgttatttgttgttacactgctactttaatgaaagactgtttcgagaacaagaccggcattatcacttatcctgatattggagaagcagcttttggcaaatatggtcgtattcttatctgtatgctattgtacacagaactatattcatattgtgttgaattcatcattttggaaggagataaccttaccgggcttttccctggtacatccttggatttgctcgggttccgacttgactctaagcatttatttggaatcttaactgctctcattgttcttccaactgtttggttgaaagatctacgcatcatttcctacctctcagccggtggagttatcgcaaccgctttgatagcagtaagcgtgtttttcctcggtacaacgggcgggattgggtttcatcacaccgggcaggctgtgaaatggaacgggataccgtttgcaattggtatatacgggttttgctattcaggacattcagtgttcccaaatatataccaatccatggctgataaaaccaaattcaacaaagcagtgatcacttgtttcattatatgtgttttgttatacggaggagttgcaatcatgggttatctcatgtttggagaagctaccttgtctcagattacactaaacatgccacaggaccaatttttctcaaaagtggcacagtggacaacggttgtgagtccgtttacaaaatacgctctcctgatgaatccacttgcaaggagtatagaagaactattaccggaaagaatgtcagagaacatatggtgctttcttcttctaagaacagcactcgtcgcttcttctgtttgttctgctttccttattccattttttggtcttatgatggctcttataggatctcttctcagtatactagtggcaataataatgccagctttatgcttcataaagataatggggaacaaagcaacaagaacacagatgattctgagttcgatcattgtggccatcggggtggtaagcgggaccttggggacatattcttcggtggcaaagatcattaggaactatcagtga

SEQ ID NO: 109 - DNA, 885 bp, Arabidopsis thaliana
atgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaa

SEQ ID NO: 110 - protein, 133 aa, Zea mays
MAARAALLQLAVSLVILAAVASASATNCPPPPLPPAPKPPTPGGHHGHGSCPRNALKLGVCANVLGLVKAKVGSPPYEPCCSLLDGLVDLEAAVCLCTAVKANILGINLNLPIDLSLILNNCGKNCPNDFHCA

SEQ ID NO: 111 - protein, 133 aa, Oryza sativa
MAAKAALVLAVSLLVVAVASACTYCPEPPTPKPKPPAPRPPTPGGGAGSCPRDALKLHVCANVLGLVKAKIGAVAPYEPCCSLLDGLVDLDAAVCLCTAIKANVLGLNLNIPIDLSLILNNCGKICPSDYQCA

SEQ ID NO: 112 - protein, 135 aa, Glycine max
MESSRTSTTLALFLTINLLFFVMASGCYTCTQPKPNPIPFPYPNPSPAAKSCPRDALKLGVCANVLNGPIGAIVGSPPDHPCCSVLEGLLDLEVAVCLCTAIKANILGINLNIPISLSLILNACEKSPPSDFLCN

SEQ ID NO: 113 - protein, 66 aa, Zea mays
MGQCSSSQHPEAEQQKQQQAAACVDIQKRQEQLRKKAAAHMNQPYQASSNDELVLLVSLDSITKIG

SEQ ID NO: 114 - protein, 101 aa, Zea mays
MAKPSQVLVSALAAWAVVLLLLCAAAPRGADAATACDAAQLTPCAGAIIGSSPPTAACCSRLKEQQPCLCTYARDPKLQRYVSSPNGKNAMAACKVPVPSC

SEQ ID NO: 115 - protein, 96 aa, Hordeum vulgare
MKYLAQLVVALLAFSAVVLMVAPAGAEAATCNALQLTPCAGAIMGNAAPTASCCSKMREQQPCMCQYARDPNLKQYVDSPNGKKVMAACKVPVPSC

SEQ ID NO: 116 - protein, 94 aa, Oryza sativa
MAKVALAVAAMAVLLLLAAAAAPGAEAACDALQLSPCASAIIGNASPSASCCSRMKEQQPCLCQYARDPNLQRYVNSPNGKKVLAACHVPVPSC

SEQ ID NO: 117 - protein, 169 aa, Zea mays
MAMPRAAGAGSLRFLGLLKQPESDAAAPFELDERDVVWPAGGGQQDGWAAPPAPRRRAHAVPLYSFGLSSLLAEGCGGGVPVPVPGRAMAPSAAPRQSAPVRVPAPWPGGRRADEDEEDGEEVVPPHVVAARRHARSSSVLEGAGRTLKGRDLRSVRNAVLRQTGFLDL

SEQ ID NO: 118 - protein, 126 aa, Zea mays
MSSMMNALANWLANPRRNPLARLHMHAVSSRLRKYGLRYDDLYDPYFDLDIKEALGRLPREVVDARIQRLKRAMDLSMKHQYLPEDLQAQQVPFRGYLGDMLALVKKESAERQSLGALPLYQRTLP

SEQ ID NO: 119 - protein, 175 aa, Oryza sativa
MFHKLRGPTPTTQSQATVRSPLSSNQTQAKHPPHRRRERERESVEASGRFSKMLSSLSAWLVNPRRNPLARLHMNAVASRLRKYGLRYDDLYDPYHDLDIKEALARLPREVVDARNQRLKRAMDLSMKHQYLPADAQAKQTPFRGYLSDMLALVKKESAEREALGALPLYQRTIP

SEQ ID NO: 120 - protein, 163 aa, Zea mays
MAQRDKKEEPTELRAPEIALCANNCGFPGNPATQNLCQSCFSASRSSSSSSQPSPTSSPSASAPAAAVPQPRPALLDAALQLAPPAAAAGQPVEASARTSANRCSSCRKRVGLTGFRCRCGDLFCGAHRYSDRHGCRYDYRGAARDAIARENPVVRAAKIVRF

SEQ ID NO: 121 - protein, 176 aa, Sorghum bicolor
MAQRDKKVEEPTELRAPELTLCANSCGFPGNPATNNLCQACFQAATASSASASVSPPSPSSSLSPSPAVFKFDEQQHARPSATAVFADRPAEQPPAPASARPIRTTSTSSSSSVNRCQSCRKRVGLTGFRCRCGELFCGAHRYSDRHDCCFDYKAVGRDAIARENPVVRAAKIVRF

SEQ ID NO: 122 - protein, 73 aa, Zea mays
MSTTTPTNAASQQGDDAAAGGADKKPAQETVTKTVQTVEVRSSAGQPDEEGVLKPVKVVHEIPAKDSSGVKQD

SEQ ID NO: 123 - protein, 70 aa, Sorghum bicolor
MSTTTTNAVSQQKDAADKKPAQETVTKTVQTVEVRSSAGQPDEEGVLKPVKVVHEIPAKEAKDNSGVKQD

SEQ ID NO: 124 - protein, 69 aa, Hordeum vulgare
MSTTDNSSPKDAPAPASSAPAAGSEPTVTKTVQTVEVRQSAGQEEGQGVIKPIEVVHEIPAKEPATKQE

SEQ ID NO: 125 - protein, 377 aa, Zea mays
MAPQTATRVASGRLVFGAPTTTDGKLVKGGSRLRVRSLDNNGRRVAVEAVNGAARPNGAAAVADVRQVPAPPPPEGDGDGVAFRLGKFAEGRLVYRQQFVVRSYEIGPDRTATMETLMNLLQETALNHVMCSGLAGDGFGATRQMSLRKLIWVVTRINIQVDEYSRWGDVVEIDTWVASSGKNGMRRDWIIRDRNTKNMIARATSNWVMMNRETRRLSKIPDEVRQEVLPFYPDRSIIAAATGGGRKIEKLTDSTAEHIRSGLAPRWSDMDVNQHVNNVKYIGWILESVPLDVLEDYHLTSITLDYRRECRQSQLLESLTSMTTSSSAPAEPPLTSSLCGSDLYSTHLIRQQDDRAEIVRACAEWRRKEHPRSIEQL

SEQ ID NO: 126 - protein, 101 aa, Sorghum bicolor
METLMNLLQETALNHVMCSGLAGDGFGATLQMSLRKLIWVVTRINIQVDKYSRWGDVVEIDTWVASSGKNGMRRDWIIRDRNTKNMIARATSNWVMMNRET

SEQ ID NO: 127 - protein, 425 aa, Oryza sativa
MAGSLAASAFFPGPGSSPAASARSSKNAAVTGELPENLSVRGIVAKPNPPPAAMQVKAQAQTLPKVNGTKVNLKTVKPDMEETVPYSAPKTFYNQLPDWSMLLAAITTIFLAAEKQWTLLDWKPKKPDMLVDTFGFGRIIQDGMVFRQNFMIRSYEIGADRTASIETLMNHLQETALNHVRTAGLLGDGFGATPEMSKRNLIWVVSKIQLLVEQYPAWGDTVQVDTWVAAAGKNGMRRDWHVRDYNSGRTILRATSVWVMMHKKTRRLSKMPDEVRAEIGPYFNDRSAITEEQSEKLAKTGNKVGDDATEQFIRKGLTPRWGDLDVNQHVNNVKYIGWILESAPISVLEKHELASMTLDYRKECGRDSVLQSLTTVSGECTSIGADKQASAIQCDHLLQLESGADIVKAHTEWRPKRSHAAAENA

SEQ ID NO: 128 - protein, 177 aa, Zea mays
MGICVSCDAADEGAATARVVLPSGELREYAPPATAGTALQAAGGEGPWLLCDADGMAFEGPVAVAAVAPGEELQAGQIYFVLPAEMRRRRLTREEVAALAVRASSALVKAAQPSSPCRRLRRGAVAPLVFPVPEEEYAAADAVSPVAAKPHQKRRVACRSGRASRFSPDLTAIPESE

SEQ ID NO: 129 - protein, 233 aa, Zea mays
MVLSGGLVVPWLAAAVAVAALAITAAPVGADAYKNYTVGDDKGWYDGLSLPGVDYQAWADGKNFSLGDFLIFNTDKNHSVVQTRNVTLYESCDYNDSGPDDTVEWVAAPPEFSKDAVTVAVPLLDEGRAYFFSGNYDGEQCESGQRFAVDVAHGQGLPPDLRPPVADAPAPSSAGPADGAAALDFSHPKNVTTPSATDDDDEQLGGGSASSSLRSALPVTATLLITLLFAFAV

SEQ ID NO: 130 - protein, 237 aa, Glycine max 1
MEQGRRRRSSFGPMSSTIPCLLLLLFCLSGSAEAYKNYTVGDSLGWFDNTEKSNVNYQKWADSKEFSLGDFLIFNTDTNHSVVQTYNFTTYKECDYDDAQDKDTTQWSAADPSNTQTHPVTVSVPLVKEGMTYFFSGDYDGDQCKSGQHFKINVTYGQGLPKSLKSPEDAPSPASPVAGDDESAPDTIVPSNFSHPKEESDDDKASDSDKQKSSSSISISMYAQLHIVLLGILLFLF

SEQ ID NO: 131 - protein, 234 aa, Glycine max 2
MERGRRSSSFGPMSSTVPCFLLLLFCLSGSAEAYKNYTVGDSLGWFDNTEKSNVNYQKWADSKEFSLGDFLIFNSDTNHSVVQTYNFTTYKECDYDDAQDKDTTQWSASDPSNTQTHPVTVAVPLVKEGMTYFFSGDYDGDQCKSGQHFKINVTYGQGLPKSLKSPEDAPSPASPVAGDDDSAPDTIVPSNFSHPKEENDDDKASDDQKSSSSVSILMHAQLHIVLLGILLFLF

SEQ ID NO: 132 - protein, 126 aa, Zea mays
MAPKVALFLALSLLFAAAAHGCEPYCPGPVVPTPPVVPSHSHGRCPIDALKLKVCANVLDLVKVGLPQHEQCCPLLEGLVDLDAALCLCTAIKANVLGIHLNVPLSLNLILNNCGKICPKDFTCPN

SEQ ID NO: 133 - protein, 375 aa, Zea mays
MDTSKSKQGPEHLLVLVHGIMASPKDWTYGEAVLKRRLGDDFFIYASSTNSYTKTFDGIDVAGRRLANEVLDVVNKMPSLRNISFLAHSLGGLFARYAIAILHPVSVETKNAGQSSALTVPTTRGPAKSRCASGLGSIAGLQPINFITLATPHLGVRGRNQLPFLQGLSILEKLAAPLAPLIVGRTGAQLFLTDGDPSKPPLLLQMASDCDDKNYISALAAFKNRVLYANVSYDHMVGWRTSSLRREKNLIKPSHRSLDGYKHIVNVEYCSPVSSEGPHFPSKAARAKEAAQRTPNRENTEEYHQMMEEEMLHGLQKVGWKKVDVNFHSSFWPYSAHNNIHVKNEWLHNAGAGVIAHVADSIKQQESRPCLPANL

SEQ ID NO: 134 - protein, 136 aa, Hordeum vulgare
MVGWKTSSIRRELDLRMPLRRSLDGYKYIVNVEYCSPVSSDGPHFPSRAARAKEAAQSTPNMENTNEYHQMMEEEMIRGLQRVGWKKVDVNFHASLWPYSAHNNMHVKNEWLHNAGAGVIAHVADSMKQTCLPSNL

SEQ ID NO: 135 - protein, 170 aa, Sorghum bicolor
MASDCDDKKYILALAAFKNRVLYANVSYDHMVGWRTSSLRREKDLIKPLHRSLDGYKHIVNVEYCSPVSSEGPHFPSKAARAKEAAQRTPNRENTEGYHQMMEEEMIHGLQKVGWKKVDVNFHSSFWPYSAHNNIHVKNEWLHNAGAGVIAHVADSIKQQESRACLPANL

SEQ ID NO: 136 - protein, 161 aa, Zea mays
MVSGSISEEIAVAVPAERMWKVAFAETKSALLPKACAGYVDAVEVDGDGGPGSVTTMKLNPSLGENKTLKSRVVALDAAARVVRTEVLQGGTVSAQLRTHFAEIRVEAAGEGACVAKVKVDYERLDGAPLAPEDEARLAQGYVRLVRMVEAYLVAHPDEFA

SEQ ID NO: 137 - protein, 166 aa, Hordeum vulgare
MVVGCVITEQCALAVSTERLWKVVYSGEDTAALPKACAGFIDAVDVEGDGGPGSVFTMTLSPAAAELSGSDVMKSRVVARDNAARVFKTEVLEGDKVSGQLKSQAVEMKLEAAGDGACVAKLRVEYERLDGGGALSAEDQAALAAGYLDLLKMVEAYLVAHPAEYA

SEQ ID NO: 138 - protein, 160 aa, Oryza sativa
MAPVSISDERAVSVSAERVWKVFSDAPAMPKVCAGFIDAIEVEGDGGAGTVTTMKLNPAVDDGGSFKTRVVARDNAAHIIKSEVLDVPAGSKVGKLKSHVTETKIEAAGAGSCLAKINVEYELEDGGSLSPEKEKLILDGYFGMLKMIEDYLVAHPTEYA

SEQ ID NO: 139 - protein, 225 aa, Zea mays
MAASSYFLLAAFLAVTASHATASDPSPLQDFCVADIHSPVKVNGFVCKDPMAVTPDDFFKAANLDKARDTMKSKVGSNVTLINVIQLPGLNTLGISLARIDYAPLGENPPHTHPRATEILTVLEGTLYVGFVTSNPNKLFAKVLNKGDVFVFPQGLIHFQFNPVYNKPAVAIAALSSQNPGVITIANAVFGSKPPISDDVLAKAFQVEKGTIDWLQAQFWENNHY

SEQ ID NO: 140 - protein, 226 aa, Hordeum vulgare
MASSSSLFLIAVLLALVSWQATAYDPSPLQDFCVADMKSPVRVNGFPCKDPMAVNTEDFFNPAMLDQPRDTKNSKVGSNVTNINVINFPGLNTLGISLARIDYGPLGVNTPHIHPRATELLTVLEGTLYLGFVTSNPNRLFSRVVKKGDVFVFPKAMIHFQMNLAHDKPAAALSSLSSQNPGVISIANAVFGSNPPISDDVLATAFQVEKKLIDWLQSQFWENNHY

SEQ ID NO: 141 - protein, 281 aa, Zea mays
MPPPPPLLEPRDYLGAGATSSCCSSCCSSGREGAGPHLALRLGLPGSDDSPGRGADTEHARAHVDAALTLGPGPGPAPPRGSAKRGFADSLDRSAKLDGVAADDAAGGVTRVAGAAAGAPPAAKAQVVGWPPVRSYRKNTLAASATKTNGGDEGRSEAGCCYVKVSMDGAPYLRKVDLKTYSSYEDLSLGLEKMFSCFITGQNSSCKTSRRDRLTDGSRVDALQDQEYVLTYEDKDADWMLVGDLPWDLFTTFCRKLRIMRGSDAAGMAPPRPPEQTVRNK

SEQ ID NO: 142 - protein, 240 aa, Hordeum vulgare
MAPTQERDYIGLSPAAAAAATELRLGLPGTEDAAGDGGGAASGAPLTLELLSKGGAKRGFAGAVAEEEDEKKKAQPPAAKAQVVGWPPIRSYRKNTMATNFSAPRSKDEAEAKQAPAPGCLYVKVSMDGAPYLRKVDLKMYKNYKDLSLELEKKFSGFTVGHGESTEKSGRDGLSDCRLMDLKSGTELVLTYEDKDGDWMLVGDVPWRMFTDSCRRMRIMKGSDAVGLAPRATEKSKNEK

SEQ ID NO: 143 - protein, 266 aa, Oryza sativa
MAPPQERDYIGLSPAAAAALATELRLGLPGTAEEAESEGGGGGGTDAAPLTLELLPKGGAKRGFADAIVGGPAGQRREAAGGKAAAAAAEAEEEEEKKKAQAPAAKAQVVGWPPIRSYRKNTMAMSQPALKGKDDGEAKQAPASGCLYVKVSMDGAPYLRKVDLKMYKNYKELSLALEKMFSCFTVGHGESNGKSGRDGLSDCRLMDLKNGTELVLTYEDKDEDWMLVGDVPWRMFTDSCRRLRIMKGSDAVGLAPRATDKSKNRT

SEQ ID NO: 144 - protein, 349 aa, Solanum lycopersicum
MSPPLLGVGEEEGQSNVTLLASSTSLGSICIKGSALKERNYMGLSDCSSVDSCNISTSSEDNNGCGLNLKATELRLGLPGSQSPERGEETCPVISTKVDEKLLFPLHPSKDTAFSVSQKTVVSGNKRGFSDAMDGFSEGKFLSNSGVKAGDTKETSRVQPPKMKDANTQSTVPERPSAVNDASNRAGSGAPATKAQVVGWPPIRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 145 - protein, 359 aa, Glycine max 1
MMSPPAVVTEEEGRSNVSSTVASGSSQSLDRFSQNGAGLKERNYLGLSDCSSVDSSASTVPSLCDEKKENMNLKATELRLGLPGSQSPEREPDLFSLSPAKLDEKPLFPLLPTKDGICLSAQKTVVSGNKRGFADTMDGFSQGKFAGNTGMNAMLSPRPSGAQPSAMKEIPSKLQERPCSTKNGTGHNHTGASISGSAPASKAQVVGWPPIRSFRKNSMATTTNKNNDEVDGKPGVGALFVKVSMDGAPYLRKVDLRSYTTYQELSSALEKMFLSCFTLGQCGSHGAPGREMLSESKLRDLLHGSEYVLTYEDKDGDWMLVGDVPWEMFIDTCKRLKIMKGSDAIGLAPRAMEKSKSRS

SEQ ID NO: 146 - protein, 195 aa, Zea mays
MAAITAGLLVLLAAAVAAPAHATDYTVGDSSGWSSGVDYATWASGKTFAAGDNLVFQYSAMHTVVEVSSADYGACSASNSIQSYSDQNTKIALTAPGTRYFICGTPGHCGNGMKLAVTVAAGTATTTPASSPPAADSPPETATPSGSTPTATTSPSAPTTKPTSSSTGAACGGEARLAMGVLAWAAGLAGLALMG

SEQ ID NO: 147 - protein, 83 aa, Hordeum vulgare
MPAAPTREPITERASIPLAPPTLSADLDEEGAVVVPAGVVDVEGVSEGVEGEVAGVGVVAAAGATLTASFMPPAQWPLTPQMK

SEQ ID NO: 148 - protein, 97 aa, Oryza sativa
MARPTAPTSRPITERASLPLAPPVLPVDFVVVVVGVVVASGVDEGVSMPGSDDGVAGVAVDGGDDDAVGVGVVAAAAETVTASFMPPEQWPLVPQMK

SEQ ID NO: 149 - protein, 187 aa, Glycine max
MASAIAASFLVLLLAFPTVFGADHEVGDTSGWALGVNYNTWASGKTFTVGDTLVFKYDSTHQVDEVDESGYNSCSSSNSIKNYQDGNSKIELTSPGKRYFLCPISGHCAGGMKLQINVAAASGTPPTTPSGTPPTTPSNPSPSPPSESGSTNTTSPPKPSGAVTVSSGIGLLVGSFFVSAIMFGFMG

SEQ ID NO: 150 - protein, 180 aa, Solanum lycopersicum
MGKLLAVTFLFMCCVVPSLAKVYTVGDSSGWGLGVDYTTWASGITLNVGDSLVFNYPSGHTVDEVSSSDYSSCTTGNSITSDSSGATTIPLKTAGTHYFICGVMGHCSGGMKLAVTVAAAGGSGGATTPSTGTTTPTTGTTAPKTETTNTTHPSASVTLSPFIPLLISGVVAIFSYFVTI

SEQ ID NO: 151 - protein, 251 aa, Zea mays
MLDIQKRRVRLLLFITAVLALSITAEKFRELVGKEAASKSGQFTFMNCFDMGSGSLACTAKEGVKLYVNNIRSAHLEMVRQRAMEKALADAVTEGLTPSEAAKQAQKISAKATKLAARQAKRILGPIISCGWDFFEAMYFGGSMTEGFLRGTGTLFGTYMGGFHGEERFGKLGYLAGSHLGSWGGGRIGLMIYDIISGLKFMFQSIQPEYESSSYAEDGPEYAESYTNQEDSTYYETSEEKQEESKWFGLF

SEQ ID NO: 152 - protein, 261 aa, Hordeum vulgare
MLDIQKRRVQLLLFVTGVLALSMTAEKCRELVGKEAASKSGQFTFMNCFDMGSGSLACAGKEGVKLYVNNIRSAHMERVRQRALEKALADALTEGLSPAEAAKQAQKVGAKATKVAARQAKRILGPIISSGWDFFEAMYFGGSMTEGFLRGTGTLFGTYAGGFHGEERLGKLGYLAGSQLGSWVGGRIGLMVYDVINGLNYMLEFVRPEEYRRSSSSSHYASEEGSEYLDDYRSGEGYEPTFSETLEEAQEEEESRGFSLF

SEQ ID NO: 153 - protein, 218 aa, Sorghum bicolor
MLDIQKRRVRLLLLITGVVALSMTAEKFRELVGKEAASKSGQFTFMNCFDMGSGSLACTAKEGVKLYVNNIRSAHLEMVRQRAMEKALADAVTQGLTPGEAAKQAQKVSAKATKVAARQANRILGPIISCGWDFFEAMYFGGSMTEGFLRGTGTLFGTYVGGFHGEERFGKLGYLAGSQIGSWGGGRIGLMIYTNREESTYYETSEEKQEESKWFGLF

SEQ ID NO: 154 - protein, 217 aa, Oryza sativa
MLDIQKRRVQLLLFIVGVLALSMTAEKFRELVGKEEASKSGQFTFMNCFDMGSGSLACAVKEGIKLYVYNLQTAHTERVRHRAIEKALADAVTEGLSAAEAAKQAQKVGAKAAKVAARQAKRILGPIISSGWDFFEAMYFGGSMTEGFLRGTGTLFGTYVGGFHGEERLGRFGYLTGSHLGSWVGGRIGLMIYDVINGLKYMLQFVKPEYEASAYYS

SEQ ID NO: 155 - protein, 173 aa, Glycine max 1
MSPTDSAKHAQKEGKKAAKLASRQAKRIIGPIISSGWDFFEAIYYGGTVTEGFLRGTGTLFGTYAGGFLGEQRLGRIGYLLGSHLGSWVGGRIGLMVHDVANGVHLLLQFVQTGEIEVHEKSKRSESSSFFGETPVYDSSEGSGVYESPPSEESYAYESTERQSYETYEDSEL

SEQ ID NO: 156 - protein, 166 aa, Glycine max 2
MSSGTLACSVKESVKLYFYNIRAAHVEGARHDALQSALVDALKQGMSQSASAKYAKKEGDKAAKLASRKARRIIGPIISSGWDFFEAVYYGGTLTEGFLRGSGTLFGTYAGGFLGEQRLGRFGYLVGSHLGSWIGGRIGLMLYDVANGVHFLLHSVQSLGSDPSSR

SEQ ID NO: 157 - protein, 274 aa, Solanum lycopersicum
MIEKKRVQVLLFLVGLLILSITAEKCRELVGQEAASKSGEFTWLQCFDGGTGSVACLVKEGVKLYAYNIRSSHVEIARNSAIEIALADAISQGISAKEAAKVAQKERAKAAKLAVRKTKRIVGPIISAGWDFFEALYLGGTPTEGALRGSGTLFGAYWVGYLGEQTMGRFGYLVGSELGSWVGGKVGLMVYDLVNGVDHLLAFLQLKEIEVDRTVYDELYKETSSEVPKESYDSESSTYSSFEAPEESSSYEAPEESSSYEAPAYEDPEVHEEF

SEQ ID NO: 158 - protein, 590 aa, Zea mays
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 159 - protein, 586 aa, Zea mays
MGMAALLLVWALLHCAGTVTMVRASHAVYPELQSLEAEKVDETSRTGYHFQPPKHWINDPNGPMYYKGLYHLFYQYNPKGAVWGNIVWAHSVSTDLIDWTALAPGIYPSRQFDVKGCWSGSATVLPSGVPVVMYTGIDPDEHQVQNVAYPKNLSDPFLREWVKPDYNPIIAPDSGVNASAFRDPTTAWYGPDRHWRLLVGSKVGGKGLAVLYRSRDFRRWVKAHHPLHSGLTGMWECPDFFPVAVHGGGRHYRRGVDTAELHDRALAEEVKYVLKVSLDLTRYEYYTVGTYDHATDRYTPDAGFRDNDYGLRYDYGDFYASKSFYDPAKRRRVLWGWANESDTVPDDRRKGWAGIQAIPRKLWLSPRGKQLIQWPVEEVKALRAKHVNVSDKVVKSGQYFEVTGFKSSDVEVEFAIGDLSKAERFNPRWLTDPQALCKKRGARETGEVGPFGLWVLAAGDLTERTAVFFRVFRANSSSSSRLVVLMCNDPTNSTFEAQVYRPTFASFVNVDIARTKTIALRTLIEPSVVESFGAGGRTCILTRVYPKKALGDNAHLFVFNHGEVDVKVTRLDAWEMRTPKMNVPAQ

SEQ ID NO: 160 - protein, 418 aa, Zea mays
MLTCIACSKQQFSGGGPPLHEPPEDDDVVGGGAGTSAGAATPSTRHAIKALTAQIKDMALKASGAYRQCKPCAGSSAAASRRHHPYHHRGGSAFGGSDADSGASDRFHYAYRRAGSSAASTPRLRSGGAALSSGDATPSISVRTGTDFPAGDDDDDEMTPEATGGCGGKDDDAKEWVAQVEPGVLITFVSLAEGGNDLKRIRFSREMFNKWEAQRWWAENYDKVMELYNVQKFNQTVPLPATPKSEDESSKEDSPVTPPLDKERLPRTFHRQGGGAMGSSSSDSLEHHSNHYCTGRHHHHHHHGHQCCDSMGLASTPKLSSISGAKTETSSMDASMRTSSSPEEIDRSGELSVSVSNASDQEREWVEEDEPGVYITIRALPGGIRELRRVRFSREKFSEMHARLWWEENRARIHEQYL

SEQ ID NO: 161 - protein, 129 aa, Triticum aestivum
MSTAKSSVLFSSVLLLLSQRYCSCILARFSSHHSLACISLNFSRLNRTRRSSLMPPGKARMVIYTPGWSSSTHSLSWSLALLMDTESSPDLSTSSGDELVLIDASIDDVSVLAPLILDSFGVDASPTES

SEQ ID NO: 162 - protein, 361 aa, Zea mays
MALVTSGSGADQVIAEVAMNGGADPSATTVRATVVQASTIFHDTPATLDKAERLIAEAAGYGSQLVVFPEAFIGGYPRGSTFGFGISISIINPKDKGKEAFRRYHASAIDVPGPEVTRLAAMAAKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIALEGGCFVLSANQFCRRKDYPPPPEYEFAGLGEEPSADTVVCPGGSVIISPSGEVLAGPNYEGEALITADLDLGEIVRAKFDFDVVGHYSRPEVLRLVVNDQPQLPVSFTSAAERTPAAKSDIDTKSY

SEQ ID NO: 163 - protein, 240 aa, Zea mays
MGRGKIVIRRIDNSTSRQVTFSKRRNGIFKKAKELAILCDAEVGLIIFSSTGRLYEYSSTSMKSVIDRYGKAKEEQQVVTNPNSELKFWQREAASLRQQLHNLQENYRQLMGEDLSGLNVKELQSLENQLETSLRGIRTKKDHLLIDEIHELNRKASLFHQENTDLYNKINLIHQENAELHKKIYETEGQSGVNREPPTPFNFAVVETRDVPVQLGLSTLPQQNNIEPSTAPKLGLQLSP

SEQ ID NO: 164 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 165 - protein, 126 aa, Zea mays
MLDEIINYVQSLQCQVEFLSMKLSTVDPRRELDVGCFVVPRDDVTMQANRLCAPATSSSSTAFCYAARSVVTNAKGFETPVPLANHGVAADDRPLERRTRDAGPQAGSLWEEDDLQSLVLMGFRGR

SEQ ID NO: 166 - protein, 366 aa, Zea mays
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMAVGAYPFEDPEEPKNFRKTIQRILNVQYAIPDYVNISPECRHLISRIFVGDPAMRITITEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 167 - protein, 142 aa, Zea mays
MGKLWTILTHLHSLAGPTVMLLYPLYASVRAMESPSKLDDEQWLAYWILYSFVTLMEMLLESLIYWIPIWYELKLLFIAWLVLPNFRGAAFIYDKFVREQLRKHGLTAAGSVKSSSPSSKDKDKPKNKFLAFVTPKKDHEAY

SEQ ID NO: 168 - protein, 154 aa, Hordeum vulgare
MSKLWTILTHLHTLAGPGVMLLYPLYASVQAMESPSKLDDEQWLAYWILYSFVTLVEMVLESLIYWIPIWYELKLLFLAWLALPNFRGAAFIYDRFVREQLRKHGLTNHPGSGISSKKENGGRVDKSSSPSTSPKEKENAKSRFLSFVAPKKDH

SEQ ID NO: 169 - protein, 156 aa, Triticum aestivum
MSKLWTILTHLHTLAGPGVMLLYPLYASVQAMESPSKLDDEQWLAYWILYSFVTLVEMVLESLIYWIPIWYELKLLFLAWLALPNFRGAAFIYDRFVREQLRKHGLTNHPGSGISSGSKEENGGKVDKSSSPSTSPKEKENAKSRFLSFVAPKKDH

SEQ ID NO: 170 - protein, 148 aa, Saccharum officinarum
MGKLWTILTHLHSLAGPTVMLLYPLYASVQAMESPSKLDDEQWLAYWILYSFITLMEMVLESLIYWIPIWYELKLLFIAWLALPNFRGAAFIYDKFVREQLRKHGLTSAAASGKKDDGKSSSPSSKDKDKPKNKFLAFVTPKKDHEAY

SEQ ID NO: 171 - protein, 152 aa, Oryza sativa
MGKLWTILTHVHSLAGPTVMLLYPLYASVQAMESPSKLDDEQWLAYWILYSFITLVEMLLESLIYWIPIWYELKLLFIAWLALPNFRGAAFIYNRFVREQLRKHGLAGAGAGAAASVGKKDKSSPSSSPKDKEKTKSKFLSFVTPKKDHEAY

SEQ ID NO: 172 - protein, 146 aa, Glycine max
MGKLWTLIIQLHSIAGPVVTLLYPLYASVVAIESQSKLDDEQWLAYWIIYSFLTLTEMVLQPILEWIPIWYDVKLLTVAWLVLPQFAGAAYLYERFVREHIRKYITEKEYLYVNHQQQSKKSPNNGGKAKKFVEFVTPKKGDQEVY

SEQ ID NO: 173 - protein, 333 aa, Zea mays
MEERYEALKELGAGNFGVARLVRDKRTKELVAVKYIERGKKIDENVQREIINHQSLRHPNIVRFKEVCLTPTHLAIVMEYAAGGELFEKICSAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVEEAKTPGDMSKVVDPALLAEMAELESDEEEADADDTY

SEQ ID NO: 174 - protein, 180 aa, Hordeum vulgare
  misc_feature (179)..(179): Xaa can be any naturally occurring amino acid
MEERYEALKELGTGNFGVARLVRDKRTKELVAVKYIERGKKIDENVQREIINHRSLRHPNIIRFKEVCVTPTHLAIVMEYAAGGELFERICTAGRFSEDEARYFFQQLLSGVSYCHSMEICHRDLKLENTLLDGSPTPRVKICDFGYSKSALLHSKPKSTVGTPAYIAPEVLSRKDMMXR

SEQ ID NO: 175 - protein, 333 aa, Sorghum bicolor
MEERYEALKELGAGNFGVARLVRDKRTKELVAVKYIERGKKIDENVQREIINHQSLRHPNIVRFKEVCLTPTHLAIVMEYAAGGELFEKITTAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSECRRLLSQIFVADPSKRITIPEIKHHPWFLKNLPREISEREKANYKDSDAAEPAQAVDEIMRIVQEAKTPGDMSKVVDSALLAEMAELESDDEEADADDAY

SEQ ID NO: 176 - protein, 336 aa, Glycine max
MEERYEPLKELGAGNFGVARLAKDKKTGELVAVKYIERGKKIDENVQREIINHRSLRHPNIIRFKEVLLTPTHLAIVLEYASGGELFERICTAGRFSEDEARYFFQQLISGVSYCHSMEICHRDLKLENTLLDGNPSPRLKICDFGYSKSALLHSQPKSTVGTPAYIAPEVLSRKEYDGKISDVWSCGVTLYVMLVGAYPFEDPEDPRNFRKTIGRIIGIQYSIPDYVRVSSDCRNLLSRIFVADPAKRITIPEIKQYPWFLKNMPKEIIEAERKGFEETTKDQPNQKVEEIMRIIQAARIPGQGSKAGEGGQAGTGSLDIEDDEEIDVSGDYEQV

SEQ ID NO: 177 - protein, 223 aa, Zea mays
MVDFVRRLASALLKCCDLDIPNRPKGLEDPERLARETVFNVNEIEALYELFKKISSAVVDDGLINKDEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 178 - protein, 161 aa, Zea mays
MAQRDKKEEPTELRAPEITLCANNCGFPGNPATQNLCQSCFSASRSPSSPTSSSSSLASAASQPRPAALVVDAAAVEALAAPAAAAVGQATEAAARASASRCSSCRKRVGLTGFRCRCGELFCGAHRYSDRHGCSYDYRGAARDAIARENPVVRAAKVVRF

SEQ ID NO: 179 - protein, 126 aa, Zea mays
MADSSAPTRVMMAVNESSLKGYPHPSISCRTAFDWTLSKLVRSNPGGFHFLFVHVHVPDEDGFDDMDSIYASPEDFHQMKQRDKIRGLHLLEYFVNQCHQLGIKCEAWIRHGDPKEVICSEVKRVQ

SEQ ID NO: 180 - protein, 177 aa, Oryza sativa
MAGSSEPTRVMVAVNESSIKGYPHPSISCRAAFDWMLSKLVRSNAAGFHLLFLHVQVPDEDGFDDMDSIYASPPDFQRMKQRDKIRGLHLLEHFVNQCHQLEIKCEAWIKQGDPKEVICSEVKRVQPDLLVVGSRGLGPFQRVFVGTVSEFCVKHADCPVITIKRKADEAPQDPVDD

SEQ ID NO: 181 - protein, 199 aa, Sorghum bicolor
MASLPDPTVYYPASSNAILRAQPSSTAAASKGSFGPVFAVLAVISFLAVAACVVGRLCGRRLSRKRSADQDFYGSDAVGGDLEKGFEIKYPTMKPMASSRAMIHDIDDGFEIKFAPGKPAAWKNDSKADNKGRRHQVQVQVQGHGQHQLQHQHQQHQLVGIPKGYAVPKEYAGFRYPAEAVVRQGQIRGGAFIPAKPGT

SEQ ID NO: 182 - protein, 171 aa, Zea mays
MAEEASAPAAGTEAPPGKMTMVVGVDESEHSFYALQWALQHFFPPGQPQQYRLVVVTAKPTAASAVGLAGPGAADVLPYVEADLKRSALRVVEKAKGLCTQASDAVFEALEGDARNVLCEAVERHGAEMLVVGSHGYGAIKRAVLGSVSDYCAHHAHCTVMIVKKPKQHKH

SEQ ID NO: 183 - protein, 159 aa, Glycine max
MAASSSEKQVVVIGIDDSEQSTYALNWALDNFFPSPIFKLVLIHSRPTATSAVGFAGPGAAEVLPIVDSDLRKIGARVLETAKQLCINKSVNDVTAEVVEGDPRNVLCDAVDKYRAAMLVVGSHGYGAIKRAVLGSVSDYCAHHAHCTVMIVKKPKIKH

SEQ ID NO: 184 - protein, 170 aa, Hordeum vulgare
MAGETGATAASGPAAGKMTMVVGVDESEHSYYALQWTLLHFFSPGQQQYRLVVVTAKPTAASAVGLAGPGAADVLPFVEADLKRSSLRVIDKAKELCAQAQVSDGVFEVVEGDARNVLCEAVERHHAEMLVVGNHGYGAIKRAVLGSVSDYCTHHAHCTVMIVKKPKHKH

SEQ ID NO: 185 - protein, 154 aa, Sorghum bicolor
MTMVVGVDESEHSFYALQWALQHFFPPPPQPQQYRLVVVTAKPSAASAVGLAGPGAADVLPYVEADLKKTDLRVIDKAKALCAQVSDAVFEAVEGDARSVLCEAVERHHAEMLVVGSHGYGAIKRAVLGSVSDYCAHHAHCTVMIVKKPKHHKH

SEQ ID NO: 186 - protein, 167 aa, Zea mays
MAGAEGERWVGLATDFSEGSRAALRWAAANLLRAGDHLLLLHVIKEPDYEQSEAILWESTGSPLIPLSEFSDPIIAKKYGAKPDIETLDILNTTATQKDIVVVVKVLWGDPREKLCQVIHDTPLSCLVIGSRGLGKLKRVLLGSVSDYVVNNATCPVTVVKSTSTEG

SEQ ID NO: 187 - protein, 129 aa, Zea mays
MVEKQMEVKLESAAEELLPVATRSAAAAAVYNKDGSTDSDSSAVFNEEASPYPYSGAALDHQQQQETSHPLGFTGFTSFLTSSFPSVYHGDSHLDQEADVFFSAAAAGDGFFAEEQSAGIGSWYGGEGW

SEQ ID NO: 188 - protein, 273 aa, Zea mays
MEWVDRTKASAAAAAAAADERAGGAEGLAGYVKVMTDEQMEVLRKQISIYATICEQLVEMHRALTEHQDTIAGIRFSNLYCDPQIIPGGHKITARQRWQPTPMQLQILENIFDQGNGTPSKQRIKEITAELSHHGQISETNVYNWFQNRRARSKRKQAASLPNNAESEAEVDEESLTDKKPKSDRSLQDNKAMGAHNADRISGMHHLDTDHDQIGGMMYGCNDNGLRSSGSSGQMSFYGNIMPNPRIDHFPGKVESSRSFSHLQHGEGFDMFG

SEQ ID NO: 189 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKHGLQSLSKGGAPPRFLIIDDGWQQIASENKPDPNVAVQEGAQFASRLTGIKENTKFQTKPDGDGDGEQAPGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVVVFFLYNGCISCMCHNSDMLYSAKQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVAGDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLLVPEQELYLWTLEIMI

SEQ ID NO: 190 - protein, 753 aa, Oryza sativa
MTVGAGVAVQDGGLVALGATVLTEVRDNVLLTPAAGAGMTSGTFVGVRSATAGSRSVFPVGKLRGLRFICTFRFKMWWMTQRMGTSGRDIPFETQFLLVEAADADGSHLAGDGAAAVYTVFLPILEGPFRAVLQGNSDDELEICLESGDPAVESFEGTHLVFVGAGSDPFEVITNSVKAVERHLQTFTHREKKKMPDMLNWFGWCTWDAFYTDVTSEGVMEGLQSLGKGGTGPKFVIIDDGWQSVSMDPAGIASLADNSANFANRLTHIKENHKFQLNGRKGHREENPANGLAHIVNEIKGKHQLKYVYVWHAITGYWGGVRPGADGMEHYESKMQYPVSSPGVQKNEPCDALNSITTNGLGLVNPDRVFSFYNELHAYLASAGIDGVKVDVQNILETLGAGHGGRVLLARKYHQALEASIARNFRDNGIICCMSHNTDNLYSSKRSAVVRASDDFWPRDPASHTIHIASVAYNTVFLGEFMQPDWDMFHSVHPMAEYHAAARAVGGCAIYVSDKPGNHDFNLLKKLVLPDGSILRAKLPGRPTRDCLFSDPARDGKSILKIWNLNEHSGVIGAFNCQGAGWCRVGKKNLVHDEQPATVTGVIRAQDVHHLATVAADGWNGDVIVYSHIGGEVTCLPKNASLPVTLKTREYEVFTVVPLKKLDNGVSFAAVGLIGMFNSGGAVTAVRYVEDAGVEVRVRGSGTVGAYSSAKPARVVVDSEAAEFSYDDGCGLVTFELAVPEQELYSWTISIEY

SEQ ID NO: 191 - protein, 757 aa, Hordeum vulgare
MTVTPQITVGDGRLAVRGRTVLSGVPDNVTAAHAAGAGLVDGAFVGATAAEAKSHHVFTFGTLRDCRFMCLFRFKLWWMTQRMGTSGRDVPLETQFILIEVPAAAGNDDGDSSDGDSEPVYLGMLPLLEGQFRTVLQGNDQDELQICIESGDKAVETEQGMNNVYVHAGTNPFDTITQAVKAVEKHTQTFHHREKKTVPSFVDWFGWCTWDAFYTDVTADGVKQGLRSLAEGGAPPRFLIIDDGWQQIGSENKDDPGVAVQEGAQFASRLTGIRENTKFQSEHNQEETPGLKRLVDETKKEHGVKSVYVWHAMAGYWGGVKPSAAGMEHYEPALAYPVQSPGVTGNQPDIVMDSLSVLGLGLVHPRRVHRFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLRKLVLPDGSVLRAQLPGRPTRDCLFSDPARDGASLLKIWNMNKCAGVVGVFNCQGAGWCRVAKKTRIHDEAPGTLTGSVRAEDVEAIAQAAGTGDWGGEAVVYAHRAGELVRLPRGATLPVTLKRLEYELFHVCPVRAVAPGVSFAPIGLLHMFNAGGAVEECTVETGEDGNAVVGLRVRGCGRFGAYCSRRPAKCSVDSADVEFTYDSDTGLVTADVPVPEKEMYRCALEIRV

SEQ ID NO: 192 - protein, 764 aa, Sorghum bicolor
MTVTPWITVSDGTLAVRGRTVLTGVLDNVSAAHAAGAGLVDGAFVGAHAAEPKSHHVFTFGTLRDCRFLCLFRFKLWWMTQRMGVSGRDVPLETQFMLIEVPPAATDGDGKPAYVVMLPLLEGQFRAALQGNDRDELEICVESGDKAVQTEQGARMVYLHAGDSPFDAVTAAVKAVEKHLQTFHHRERKRMPSFLDWFGWCTWDAFYTDVTAGGVKHGLQSLSKGGAPPRFLIIDDGWQQIASDNKKPDDPNVAVQEGAQFASRLTGIKENTKFQTKPDGDGDGDGGLKRLVSETKGVHGVKQVYVWHAMAGYWGGVAPSSGTAMERYEPALAYPVQSPGVTANQPDIVMDSLSVLGLGLVHPRRARDFYGELHAYLASCGVDGVKVDVQNIIETLGAGHGGRVALTRAYHRALEASVARSFPDNGCISCMCHNTDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDAAPGTLTGAVRADDVDAIARVAGDGGNDGDNGSNGEWDGEAVVYAHRARELVRLPRGAALPVTLAPLQYEVFHVCPLRAAAPGVAFAPVGLLDMFNAGGAVEECRAVDGGGKAVVALRVRGCGRFGAYCSREPARCLLDSAEVEFGYDADTGLVSVDLPVPEKEMYRWTLEIVV

SEQ ID NO: 193 - protein, 529 aa, Zea mays
MAPEKPRKEQEEELMLEDGGIEESPRRSFEDCGDSEEDRGEGDDEEERDSDRDGVGSTRSFLPQKWPQSYRETTDTYTIAASPSFGYLGSSTSKYSLLDLGRSILGSDLKSPLISAKADSVRNLPKTLGSMRDGRVSFQLQHTGEIYISQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTTIFPKAGVDWFGIHVDGKHFFGVLTAILVLPTVWLRDLRVLSYLSAGGVIATLLVFLSVGLVGATDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGT

SEQ ID NO: 194 - protein, 108 aa, Sorghum bicolor
MTPNIMIPMLAITCEQVALFCAIFRKHKAGIMTATSILRRDPMSAITRPKNGRRNAMHTVDATRAVLSIIEHDVSFKKPSGRNSSKLRANGFNNKAYLVKGLITVVHS

SEQ ID NO: 195 - protein, 373 aa, Zea mays
MLEEYKPCAAMVVTQCIYAALALLSKAAFTGGMSPLVFVVYRQAVATIVLVPVVIAANRKKMKEMTTGLGLTGFSLVFVASLVGATVNQCMYYQGVNLGSSSMATAMTNLIPAITFVMAASVGLERVEARRPRSLAKIFGTAVCVSGAMAMAFFKGPKLLGDGPNALQLLLHAGGGGRWVAGALFLVASSSCWSLWLILQVPICKSYVEPLALSAWMCVLSTLQSALLVSFLLPDPSAWRIHSLFELSCCVFSGVFGSGVTFYLQSWCISVRGPLYSAMFNPLCTVITTVFAAAVLREELHVGSLLGAIAVIAGLYVVLWGKAGDANKGGVEPEHHSDDLEKTSSARSDPNSTAGVGSGIAEPLLAGGDPTEK

SEQ ID NO: 196 - protein, 459 aa, Zea mays
MGIGDGSSNGNQQPVHKEIRDETTPLLPVKVEEDEGFHEFNGASFSGAVFNLSTTIVGAGIMALPASIKMLGIIPGILLIILVALLTEASIDMLVRCSHQGKITSYGWLMGEVFGQWGRIALQASVIINNVGVLIVYMIIIGDVLSGTTSGDVHHRGILEGWFGAHLWNSRAIVLLATALLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITVSLLAVIYLAAILIPSIWDAFQFTGATAAVLIGFIFPAMVILRDSYGIASKRDKILAVTMIVLAVLSNSVALYSDAMNIFRKKEVA

SEQ ID NO: 197 - protein, 455 aa, Sorghum bicolor
MGIGNGSSSNVSHKAMQDETTPLLPIKAEEDVVHEFDGASFSGAVFNLSTTIVGAGIMALPASIKMLGLIPGILMIILVALLTEASIDMLVRCSHQGKITSYGWLMGDTFGQWGRIALQASVVINNVGVLIVYMIIIGDVLSGTSSTGVHHSGVFEGWFGPHMWNSRPIVLLTTTLVVFAPLVSFKRLDSLRYTSALSVALAVVFVVITAGVAIVRLIQGTVEIPKLFPEIDGVSSVWKLFTAVPVLVTAYICHYNVHSIDNELEDKTQIKPIVQTSLGLCSSVYIATSFFAYLLFGEATLADVLANFDSDLRIPFSSVFNDIVRVSYVVHIMLVFPIVFFALRLNLDGLLFPTARHISHDNKRFTIITISLIAVIYLAAIFVPSIWDAFQFTGATAAVLIGFIFPAMIILRDPYGVSTKRDKVLAVTMIVLAVVSNSVALYSDALNIFYRKQEA

SEQ ID NO: 198 - protein, 390 aa, Hordeum vulgare
MLGLIPGLLMIVFVALLTEASIDMLIRCSHQGKITSYGWLMGEAYGQWGRIALQASVVINNIGVMIVYMIIIGDVLSGTSSGGVHHRGILEGWFGAHLWNSRAIVLLVTTLFVFAPLVSFKRLDSLSYTSALSVALAVIFVVITAGIAIIKVFNGTVAMPKLFPEIDSLSSVWKLFTAVPVLVTAYICHYNVHSIDNELEDKTQTKPIVRTSLALCSSVYIATSFFAYLLFGEGTLDDVLANFDSNLGIPFSSVFNDIVRVSYAAHVMLVFPIVFFALRLNLDGLLFPTSRHISHDNKRFTIITISLLVVIYTAAIFIPSIWDAFQFTGATAAVLIGFIFPAMVILRDPYGIATKRDKILAVTMIVLAVVSNSVALYSDAMNIFRRKEVA

SEQ ID NO: 199 - protein, 460 aa, Hordeum vulgare  2
MGIGDGSPSETQHAAHKEKRDETTPLLPLKAEEEDGIHEFNGASFSGAVFNLSTTIVGAGIMALPASIKMLGIIPGILMIILVALLTEASIDMMVRCSHQAKITSYGWLMGDSFGQWGRIALQASVVINNIGVMIVYMIIIGDVLSGTSTTGVHHRGIFEGWFGPHLWNSRPVVLLATTIFVFAPLVSFKRLDSLRYTSALSVALAVVFVVITAGIAILRLIEGTAEIPKLFPEIHEINSIWELFTAVPVLVTAYICHYNVHSIDNELEDRSQTKPIVANFTGFVFKVFMLPQVSLHISSFGEATLSDVLANFDSDLHIPFSSVFNDIVRVSYVVHVMLVFPIVFFALRLNLDGLLFPTSRHISHDNRRFTIITVSLLVVIYLAANFIPSIWDAFQFTGATAAVLIGFIFPAMIILRDSYGIATKRDKVLAVTMIVLAVLSNSVALYSDAMSIFYRKVEA

SEQ ID NO: 200 - protein, 232 aa, Triticum aestivum 1
MPKLFPEIDDLSSVWKLFTAVPVLVTAYICHYNVHSIDNELEDKTQTKPIVRTSLALCSSVYIATSFFAYLLFGDGTLDDVLANFDSNLGIPFSSVFNDVVRVSYAAHVMLVFPIVFFALRLNLDGLLFPTSRHISYDNKRFTIITISLLVVIYTAAIFIPSIWDAFQFTGATAAVLIGFIFPAMVILRDPYGIATKRDKILAVTMIVLAVVSNSVALYSDAMNIFRRKEVA

SEQ ID NO: 201 - protein, 317 aa, Triticum aestivum 2
MCYQEHLQLVFITGVSLRGGLVLICGILVQLFSLPQLFFVFAPLVSFKRLDSLRYTSALSVALAVVFVVITAGIAILRLIEGTAEIPKLFPEIHEINSIWELFTAVPVLVTAYICHYNVHSIDNELEDRSQTKPIVRTSLALCSSVYVATSFFAYLLFGEGTLSDVLANFDSDLHIPFSSVFNDIVRVSYVVHVMLVFPIVFFALRLNLDGLLFPTSRHISHDNRRFIIITVSLLAVIYLAANFIPSIWDAFQFTGATAAVLIGFIFPAMIILRDSYGIATKRDKVLAVTMIVLAVLSNSVALYSDAMSIFYRKVEA

SEQ ID NO: 202 - protein, 432 aa, Zea mays
MGFGMGNNNNGASSSSSRLDPAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFAVDVMLVLNQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 203 - protein, 373 aa, Zea mays
MDAVAAYLGRWQVLSCGVFQYVNLVGTAVGYTITASISAAAVHKANCFHNKGHAADCSTYDTMYMVVFGIVQIFFSQLPNFSDLSWLSIVAAIMSFSYSSIAVGLSLARTISGRSGTTTLTGTEIGVDVDSAQKVWLALQALGNIAFAYSYSMILIEIQDTVKSPPAENKTMKKATLMGVTTTTAFYMLAGCLGYSAFGNAAPGNILTGFGFYEPYWLIDFANVCIVVHLVGAYQVFSQPIFAALETAAAKRWPNARFVTREHPLVAGRFHVNLLRLTWRTAFVVVSTVLAIVLPFFNDILGFLGAIGFWPLTVYYPVEMYIRQRRIQKYTSRWVALQLLSFLCFLVSLASAVASIEGVTESLKHYVPFKTKS

SEQ ID NO: 204 - protein, 202 aa, Sorghum bicolor
MKKATLMGVTTTTAFYMLAGCLGYSAFGNAAPGNILTGFGFYEPYWLIDFANVCIVVHLVGAYQVFSQPIFAALETAAAKRWPNAKFVTREHPLVAGRFNVNMLRLTWRTAFVVVSTVLAIVMPFFNDILGFLGAIGFWPLTVYYPVEMYIRQRRIQKYTTRWVALQLLSFLCFLVSLASAVASIEGVTESLKHYVPFKTKS

SEQ ID NO: 205 - protein, 487 aa, Oryza sativa
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGGVDHTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 206 - protein, 485 aa, Triticum aestivum
MARVGGGDVEIGGLPAPAGDPRRRVVAADDSLDDDGKPRRTGTVWTASAHVITAVIGSGVLSLPWSVAHLGWVAGPVTLLLFAIITYYTSVLLGDCYRSEDAVTGKRNYTYMEAVGSLLGKGQVWFCGLCQYVNLIGTAIGYTITASISAAALYKANCFHSKGHSADCGVYTTMYMVVFGISQIVFSQLPTLHEMAWLSILAAVMSFSYATIGRRPLLGTDHNRSYGARQPIGGTQIGVDVTSAQKIWLTLQALGNIAFAYSYSMVLIEIQDTVKAPPAENKTMRKANLMGVSTTTAFYMLCGCLGYSAFGNDAPGNMLTGFGFYEPYWLIDFANVCIVVHLVGAYQVYCQPIYAAVESWAAGRWPNSEFVVRQYHPFSGKFSLNMFRLVWRTAFVIVSTVLAISLPFFNDILGLLGALGFWPLTVYFPVEMYISQSKMKKYSRKWVALQTLSFACFVVTVAVTVASIQGITQSLKNYVPFKTKL

SEQ ID NO: 207 - protein, 273 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 208 - protein, 281 aa, Sorghum bicolor
MATTDLGFEETELRLGLPGGGGEVVGEGRSSVVSSGKRGFAETIDLKLKLEPATPAAVLKAAEADEHQDGVAAAKEDAGCVAAAEEAAVGGKMKRSPSQSSVVTAAAVQADPAEKPRAPKAQVVGWPPVRSFRKNIMSVQSDKGAGGSKDADKSSPAAAAGGGAAFVKVSLDGAPYLRKVDLKMYKSYQELSKALEKMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 209 - protein, 277 aa, Oryza sativa
MAADLAFEATELRLGLPGGGGDGDAAAAAARSSSGKRGFAETIDLKLKLEPAAAAVDDDDDKEEAAADDREKKVDIVGADNDDASPPAAAAAGGMKRSPSQSSVVTAAADPEKPRAPKAQVVGWPPVRSYRKNILAVQADKGKDAADGGGDKSGAGAGAAAFVKVSMDGAPYLRKVDLKMYKSYLELSKALEKMFSSFTIGNCGSHGVNGMNESKIADLLNGSEYVPTYEDKDGDWMLVGDVPWEMFVESCKRLRIMKGSEAIGLAPRAMEKCKNRS

SEQ ID NO: 210 - protein, 244 aa, Zea mays
  misc_feature (188)..(188): Xaa can be any naturally occurring amino acid
MAHPSAAAAAVSSTAPAANPSSGAREEGGARSPPSPSPSQRGRAKVVIVMGATGAGKSRLAVDLAAHFAGVEVVSADSMQLYRGLDVLTNKAPLHEQNGVPHHLLSVIDPSVEFTCRDFRDRAVPIIQEIVDRGGLPVVVGGTNFYIQALVSPFLLDDMAEEMQGCTLRDHIDDGLTDEDEGNGFERXEEIDPVAAQRIHSNDHRKIKRYLELYATTGALPSDLFQGEAAKVRNFSLYLSALLV

SEQ ID NO: 211 - protein, 351 aa, Zea mays
MALVPSRSDSEALIPEVEMNAGADQTATTARVTVVQASSVFYDTPATLDKAEKLVAEAAGYGSQLVLFPEVFVGGYPHGSTFGLVVGIALPREKEDFQKYHASAIDVPGPEVSCLSALAGKYKVFLVIGVVERAGYTLYNTVLSFDPLGKYLGKHRKVMPTALERVFWGFGDGSTIPVYDTPIGKMGALICWENRMPLLRTAMYAKGIEIYCAPTVDCMPTWLSSMTHIALEGGCFVLSACQFCRRKNYPPPPEYTFCGLEEEPSPESVVCSGGSVIISPLGTVLAGPNYESEALLTADLDLGEIVRAKFDFDVVGHYSRPEVLSLVVKSDPKPAVSFISAAGRDDDYVQT

SEQ ID NO: 212 - protein, 461 aa, Zea mays
MDVERKVVEADDDGRVRTGTVWTATTHAITAVIGSGVLALPWSVAQMGWVLGPVALVGCAYITYFTAVLLSDCYRTPDPVHGKRNRTYMDVVRSCLGPRDVVVCGLAQYAILWGTMVGYTITTATSIMAVARTDCRHHRGHDAACASSGTVYMVAFGVVEVVLSQFPSLEKLTIISVVAAVMSCTYSFVGLFLSAAKLASNHGARGSLLGVKIAAGVSASTKTWHSLQALGNVAFAYTYSMLLIEIQDTVKAPPSENVTMKRASFYGISVTTIFYVSLGCIGYAAFGNAAPGNVLTGFDEPFWLVDVANIAVVVHLVGAYQVYAQPIFACYEKWLGSRWPDSAFFHHEYAVRLPGCAVRFTMCKLVLRTAFVAATTVVSLMLPFFNAVLGLLGAIAFWPLTVYFPVTMYIAQAKVAPGSRKWVALQALNVGALLVSLLAAVGSVADMVQRLGHVTIFQTQL

SEQ ID NO: 213 - protein, 422 aa, Zea mays
  misc_feature (16)..(16): Xaa can be any naturally occurring amino acid
  misc_feature (101)..(101): Xaa can be any naturally occurring amino acid
  misc_feature (117)..(117): Xaa can be any naturally occurring amino acid
  misc_feature (179)..(179): Xaa can be any naturally occurring amino acid
  misc_feature (188)..(188): Xaa can be any naturally occurring amino acid
  misc_feature (197)..(197): Xaa can be any naturally occurring amino acid
  misc_feature (201)..(201): Xaa can be any naturally occurring amino acid
  misc_feature (204)..(204): Xaa can be any naturally occurring amino acid
  misc_feature (217)..(217): Xaa can be any naturally occurring amino acid
  misc_feature (301)..(301): Xaa can be any naturally occurring amino acid
  misc_feature (324)..(324): Xaa can be any naturally occurring amino acid
  misc_feature (331)..(331): Xaa can be any naturally occurring amino acid
  misc_feature (376)..(376): Xaa can be any naturally occurring amino acid
  misc_feature (378)..(378): Xaa can be any naturally occurring amino acid
  misc_feature (399)..(399): Xaa can be any naturally occurring amino acid
  misc_feature (408)..(408): Xaa can be any naturally occurring amino acid
PAPPPCCSSPSSPTTXPRCSPSATARGDPDTGKRNYTYMDAVRSNLGGAKVAFCGAIQYANLVGVAIGYTIASSISMQAVSRAGCFHKRGHAVPCKSSSNXYMILFGAVQILFSQIXDFDQIWWLSIVAAVMSFTYSAIGLSLGIAQTVANGGFKGSLTGISIGADVTSTQKVWHTCRXSATSRSPTXSPTSSSRSXTRSXRRXVGVEGDAEGDAAXRGDDDHLLHAVRVHGVRGVRRQGAGQPADGVRLLRAILADRRGQRGHRGAPGGRVPGVLPAHLRLRGAPRRRAWPDSAFVSRDXAWGPLALSVFRLTWRSAFVCVTXVVAMLLXFFGNVVGFLGAVSFWPLTVYFPVEMYIKQRRVPRGSTKWVCLQTXSXRCLVVSIAAAAGSIADVIEAXKVYHPFSSXFLLLWMSWVGPGLA

SEQ ID NO: 214 - protein, 435 aa, Arabidopsis thaliana
MTPQIKTHLLPKQEPSSSENHGSSTSGIVFNVSTSIIGAGIMSMPAAFKVLGIVPAFLIITIIAWLSTISVGFLMKSTLAGESTTYAGVMKESFGKTGSIAVQIATMVATFGCMIIFSIIIGDVLSGNENGGPEHIGVLQEWFGSYWWNTRIFALLFVYGFVLLPLVLRRRVERLAISSAVSFLLAVLFVVISSVLAISALVNGQTKNPRLFPELSNGGSFWQLFTASPVIVTAFTFHFNVHPIGFELKDPLQVIPATKISVILCAAIYFATGLFGYLLFGDATMSDILVNFDQSSGSSIGSLLNDIVRLSYVLHLMLVFPLLNFSLRANLDELLYPKKPSLEKDTKRFIGLTLALLICCFLSAIAVPDIWYFFQFMGSTITVSIAFIFPAAIVLRNIHGVSTSREKIVAAIMLVLAVATSIIAISTNLYSLAAN

SEQ ID NO: 215 - protein, 427 aa, Arabidopsis thaliana
MRYDQEAGSSSHSLPSGSSSHSLPPTEDTPLLGPRTLSSQPKTFANVFIAIVGAGVLGLPYTFKKTGWLLGLLTLLFVSSLTFFCMMLLVHTRRKLESLSGFNSITSFGDLGESVCGPAGRLVVDVMLVLSQSGFCVSYLIFVATTMANLLSRGTEHILGLDAASIYLWGCFPFQLGLNSIPSLTHLAPLSIFADIVDVAATLVVMVQDVFIFLKRRPPLRVFGGVSVFFYGLGVAVYAFEGIGMVLPLELEAKYKDKFGRALGLAMGLISIMYGAFGLLGYMAYGEETKDIITTNLGTGVVSTLVQLGLAINLFFTFPLMMQPVYEVVERRLCSSRYSVWVRWATVLVVTLVALLVPNFADFLSLVGSSVCVVLGFVLPSLFHLQAFKNELSITRIVVDVLVFLIGVMIAITGTWTAVHEILTSKA

SEQ ID NO: 216 - protein, 589 aa, Arabidopsis thaliana
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 217 - protein, 536 aa, Arabidopsis thaliana
MEDKNNDKEKKTDVTFEDDEDNEDLEDNSSKYENDSETDQSDLGDLPGDAVDRDDDIDEPFISQVQWPQSFRETTDSYTIAASPIFGSLRSNPPSFYRASRSNLDVESKAPLLPERHDDSDKASATQSAWSHKGSFAEELPIGGYGCSVIQTIFNAINVMAGVGLLSTPYTVKEAGWASMVILLLFAVICCYTATLMKDCFENKTGIITYPDIGEAAFGKYGRILICMLLYTELYSYCVEFIILEGDNLTGLFPGTSLDLLGFRLDSKHLFGILTALIVLPTVWLKDLRIISYLSAGGVIATALIAVSVFFLGTTGGIGFHHTGQAVKWNGIPFAIGIYGFCYSGHSVFPNIYQSMADKTKFNKAVITCFIICVLLYGGVAIMGYLMFGEATLSQITLNMPQDQFFSKVAQWTTVVSPFTKYALLMNPLARSIEELLPERMSENIWCFLLLRTALVASSVCSAFLIPFFGLMMALIGSLLSILVAIIMPALCFIKIMGNKATRTQMILSSIIVAIGVVSGTLGTYSSVAKIIRNYQ

SEQ ID NO: 218 - protein, 294 aa, Arabidopsis thaliana
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 219 - DNA, 879 bp, Zea mays
aattcgaatcggcacgaagctagcagctcgaactagctttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcggctcgccgccgtacgagccgtgctgctcgctgctggacgggctcgtcgacctggaggccgccgtctgcctctgcaccgccgtcaaggccaacatcctcggcatcaaccttaacctccccatcgacctcagcctcatcctcaacaactgcggcaagaactgccccaacgacttccactgcgcgtagatgatcagtcagtcagttattgatcgtcgtccatcgccggccggccgtggttcatcgtcattattccgttttgcttaattgttgatcgatcgtcttcttcctgtcagtcccagcagcttatttattttaaatttgtctctttatacatatatatgagtggtgtggttacacttcgttctacatagcctagcgcctacgacgcgtgcgtgtatatgtctggcctggggtgatcagttaattactgatcggtgttgcgcagtagtgcagtacgtattattcttcatttgtagtcatatgacgatctgtttgcatggttcgttcaataaatgaagttgacaagttgtactttctttctcataaaaccgagtatggaattcgtttgaccaaataaacct

SEQ ID NO: 220 - DNA, 781 bp, Oryza sativa; identical to SEQ ID NO: 2

SEQ ID NO: 221 - DNA, 746 bp, Sorghum bicolor
cacacagcaatacagcacactagcagcagcagcagcagctcgagctagcttagctactacgtgtgtgcaatcagctcgatcgccatggctgcaagagcggcgctcatcctggctgtcagcctggtccttgctgcagtggcgagcgcgacctactgcccgccgccaccggccccaaagccgccgacgcccacgcccagcgggcaccactgccccagggactctctgaagctgggcgtgtgcgccaacgtgctgggcctggtgaaggccaagatcggctcgccgccgtaccagccgtgctgctcgctgctggatgggctcgtcgacctggaggccgccgtctgcctctgcaccgctatcaaggccaacatcctcggcatcaacctgaacctccccatcgacctcagcctcatcctcaacaactgtggcaagaactgccccaacgatttccactgcgcatagatgatcaattgatcgtcatccatcgctggccgcagttcatcaatcatcattccgtggcatgatatgatacgatgctttgcttaatttgtggttgagatcttcctgtcagttccagcttaattatttattttgattatttgtctctttatacgtgtgcatgtatatgccttgcctggggtgatcagttaattactgatcgctgttacaatgtattcttgatttgttctcatgagtcatgatctgtttgtaatggttcggtcaataaatgaagaagtagtttctttttg

SEQ ID NO: 222 - DNA, 1298 bp, Saccharum officinarum
  misc_feature (542)..(542): n is a, c, g, or t
  misc_feature (547)..(547): n is a, c, g, or t
  misc_feature (719)..(719): n is a, c, g, or t
  misc_feature (995)..(995): n is a, c, g, or t
  misc_feature (1046)..(1047): n is a, c, g, or t
  misc_feature (1142)..(1142): n is a, c, g, or t
  misc_feature (1147)..(1149): n is a, c, g, or t
  misc_feature (1163)..(1167): n is a, c, g, or t
  misc_feature (1194)..(1195): n is a, c, g, or t
  misc_feature (1197)..(1197): n is a, c, g, or t
  misc_feature (1243)..(1243): n is a, c, g, or t
  misc_feature (1257)..(1258): n is a, c, g, or t
  misc_feature (1276)..(1276): n is a, c, g, or t
  misc_feature (1295)..(1297): n is a, c, g, or t
cagcagcagctcgagctagcttagctactatacgtgtgcaagcagctcgatcgatcgccatggctgcgagagcggcgctcctcctggctgtcagcctagtcctcgctgccgtggcgagcgcgacctactgcccgccgccgccagcccccaagccgccgacgccgacgcccagcggccaccacgggtcgtgccccagggacgcgctgaagctgggagtgtgcgccaacgtgctgggcctggtgaaggccaagatcggctcgccgccgtaccagccgtgctgctcgctgctggacgggctcgtcgacctggaggccgccgtctgcctctgcaccgccatcaaggccaacatcctcggcatcaaccttaacctccccatcgacctcagcctcatcctcaacaactgtggcaagaactgccccaacgatttccactgcgcatagatgatcaattgatcgtcgtccatagccggccacggttcattgatcttcctgtcagatcattgcttaattggtgattgatcttcctgtcagttccagcctatntaatntgaactctctctctctctctctctctctctctctctatatatatatatatatatatatatatatatatatatctatatatatatatatatataggaggggggggggaccctttacaaagcccagcaccctcgcccttgttatttctggccgggggaaaatttttcctgttgnaccggtaaggcgagaaaagagctatttagatgggggcctggaagtgacagggcgtggttaaggtcagggctatggttaaagaaggggggcggttaagaggaatactgcgggtggagactagtttcatgacccctgatacgcgcggggtgagcggtggggaaatcgtggcacatatctctggcggtgtttttgagaggctgtgaagcgctccacgttccttgtcgtacgatggaattgtcaatctcgcattaggcggggagtgggtgggttgtttgnaagtaggattagttgatgtggggagggagtggaaagaagaagacagattgnnataaaaaaaaaaaaacgtgtgacctcgaacaatagtatattgtaattgtgtgtgcccgatggagtgacctctttacccctaccccttcgcagcanaaaannnccggtatcgggggnnnnnaggggatgcgcgtgacgtgcgagtcgnncntgacaatgataatatgcgttgagttttgatataaaacaccaccatncatagaggggtgtnnttgtaagtggtatgttgnggaatggtggtgttgggtnnnc

SEQ ID NO: 223 - DNA, 817 bp, Triticum sp.
gcagctcgaactagctttagctactacgtgtgcaagtgcaagcagctcactcgttcgaccatggctgcgagagcggcgctcctccagctggctgtcagcctggttatccttgccgccgtggcgagcgcgagcgcgaccgactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtaggctcgccgccgtacgagccgtgctgctcgctgctggacgggctcgtcgacctggaggccgccgtctgcctctgcaccgccgtcaaggccaacatcctcggcatcaaccttaactccccatcgactcagcctcatcctcaacaactgcggcaagaactgccccaacgacttcmactgcgcgtagatcatcagtcagtcagttattgatcgtcgtccatcgccggccggccgtggttcatcgtcatcattccgttttgcttaattgttgatcgatcgtcttcttcctgtcagtcccagcagcttatttattttaaatttgtctctttatacatatatatgagtggtgtggttacacttctacatagcccaggcagcggctacgacgcgtgcgtgtatatgtctggcctggggtgatcagttaattactgatcggtgttgcgcagtagtgcagtacgtatattcttcatttgtagtcatgacgatctgtttgcatggttcgttcaataaatgaagttgacaagttgtactttcttcctcaaga

SEQ ID NO: 224 - DNA, 853 bp, Triticum sp.
  misc_feature (816)..(816): n is a, c, g, or t
  misc_feature (822)..(822): n is a, c, g, or t
  misc_feature (832)..(832): n is a, c, g, or t
  misc_feature (837)..(837): n is a, c, g, or t
  misc_feature (843)..(843): n is a, c, g, or t
  misc_feature (846)..(846): n is a, c, g, or t
gcagctcgaactagctttagctactacgtgtgcaagtgcaagcagctcactcgttcgaccatggctgcgagagcggcgctcctccagctggctgtcagcctggttatccttgccgccgtggcgagcgcgagcgcgaccgactgcccaccgccaccgctgccgccggccccaaagccgccgacgcccggcggccaccacggccacgggtcgtgccccaggaacgcgctgaagctgggcgtgtgcgccaacgtgctgggcctgggtgaaggccaaggtaggctcgccgccgtacgagccgtgctgctcgctgctggacgggctcgtcgacctggaggccgccgtctgcctctgcaccgccgtcaaggccaacatcctcggcatcaaccttaacctccccatcgacctcagcctcatcctcaacaactgcggcaagaactgccccaacgacttcaactgcgcgtagatcatcagtcagtcagttattgatcgtcgtccatcgccggccggccgtggttcatcgtcatcattccgttttgcttaattgttgatcgatcgtcttcttcctgtcagtcccagcagcttatttattttaaatttgtctctttatacatatatatgagtggtgtggttacacttctacatagcccaggcagcggctacgacgcgtgcgtgtatatgtctggcctggggtgatcagttaattactgatcggtgttgcgcagtagtgcagtacgtatattcttcatttgtagtcatgacgatctgtttgcatggttcgttcaataaatgaagttgacaagttgtactttctttctnaaaaanagcaaagggngaganaactcnaanggggggg

SEQ ID NO: 225 - DNA, 556 bp, Zea mays
gaattccattgcgttggaaaagcaaagcaaatcaaagcacaacgagagggggagaaagagagagagagagagccatggggcagtgttcgtcctcccagcacccagaagcagagcagcagaagcagcagaagcaggctgcctgtgttgacatccagaaaaggcaggagcagctgcggcagaaggcggcggcgcacatgaaccagccataccaggcatctagcaatgacgagctggtcctcctggtgtcgctggattcaatcaccaagattgggtgaattgttcatctgcggataatcatcttgctgctgaccattacggtgaacacaacctcgtctctcctaaaatgaaggatgaagttggcaggccctctttctctttgcttgtgtcatcaatatgtaaacactcactagctaataaagctaaaaatcagactgcctccatttgtcgatttacgaaattttatcacgtaaacctgtctgtgtatttcaatgttttttgtaaaccgtccatgtatatgttgagaaaataatcacggagaccgcccttggtatcgatc

SEQ ID NO: 226 - DNA, 1737 bp, Zea mays
gcttgcgccaggagtagcgcaccgacccagcgctggtcgccctccgcgatgaggtccatgccggctccaaggccctgccatgggcgatcgtcgacgatctgctacagtacagcgggcggctgtatgttccgccggcctccccactccttcaggaactgctgttggcggtccatgatgcgggacatgagggcgtccaacacaccttgcatcggatcaggcgcaatttccattttcctaacatgaaacggattgtgcaggactttgtacgagtgtgctccacatgccagcgctataaatcagagcacctccaccctgtcggcctcctcctacctctaccagtgccacgggggtctggacggacgtggcactggacttcgtcgaggcgctttttaaagtgcgtggcaagtctgtcatcttgactgtggtggacaggttcaacaaatactgccacttcctccccttggcgcacccgtactccgccgtgagcatggctcaagctttcttcaccgacatcgttcgccttcacggcgtgccgcagtccatggtgtcggaccgtgactcggtcttaacctccaggtttttgcgcgagctgatgcgggtaaggcttggcgcttaaagatacccttccctagaccccgcacagtgtgggaagtctacgacactaggtggagtacatgctgcgatggtgggatccctgcatcctactccagttgccacactgccatttctcgctccacactctgctgtggtacctttctgtgaaggggtctacaaatacgccacagcttgggacgctttgagaaaagatgctgcagtattaactcaagatgtaacacttttggcagaagatgctgcacagaaaagcgggatcaccatcgaacaagtcagggataggttacggtcagtgttgtctttgactgatgtcactcgatttccagtcccaaagaacccacaggcggtcatctttgttggtgcaacggacgatggttatattcccagacattcagtgatggagctccagaaggccgggccggggtcaccatgtatcaatttgaatgctacatcttctgattgtctgacatgcatgtcaatcagctaggcaatttggcagttcgctcgcccgcggcgcctccagcccgcccgcccgttctgtgtcgaaccatgccgcagcaaggaaaaaagcaaagcaaagctaagcacaacgagaaggtgagaaagagagagagagagagagagagagagctatggggcagtgttcgtcctcccagcacccagaagcagagcagcagaagcagcagcaggcggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaatcagactgcctccatttgtcgatttacgaaattttatcacttaaacctgtctgtgtatttcagcaaatgttttttgtaaaccgtccatgtatatgttgagaaaataatcacggagaccgcccttggtatcgatc

SEQ ID NO: 227 - DNA, 669 bp, Zea mays
attgtgttgggaagcaaagcaaagcaaagcacaacgagaaggtgagaaagagagagagagagagagagagagagctatggggcagtgttcgtcctcccagcacccagaagcagagcagcagaagcagcagcaggcggctgcctgtgttgacatccagaaaaggtttcttcaaactactgtcttcctggcatatatatatagtcgtcgagcgactcaaaccatgcatggtgggtaaggttttcttcttcttcttccaagctgcaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaataagactgcctccatttgtcgatttacgaaattttatcacttaaacctgtctgtgtatttcagcaaatgttttttgtaaaccgtccatgtatatgttgagaaaataatcacggagaccgccctttcgtatcg

SEQ ID NO: 228 - DNA, 354 bp, Sorghum bicolor
cctcgtgccgaattcggcacgaggggaaagcacaacgagagagagagagagagagagagatggggcagtgttcgtcctcctcccagcatccaaaagcagaacagaagcagcagccagctgctggtgttgacacccagaaaaggcaggagcagctgcgaaaggcggctgcagcggcgcacatgaatcagccataccacgcatctagcaatgaggagctcgtcctacttgtgtccctggattcaatcaccaagattgggtgaattgttgatctgcagatatggcgaggtcatcgatctctatccggctccagtggtgacagctacggtgaacatcaccctcttgtctctcctataa

SEQ ID NO: 229 - DNA, 658 bp, Sorghum bicolor
ttattaaggaaaatactgaagggtcacaccaaacaacccgcaatagctgattgatacatacaagggcggcctccatgactatttctcaacatatacatgcatggtttggaaaaacatttatttcctgaagtacacgggcttaagtgataaatttgatggtacgtggagtaatataaaatttgtaaagagactaagggtggcagtctaatttgtaggttcattggtgagttttatatatggatgacacaaacagggcctgtcagctgcatccttctttataggagagacaagaggtgatgttcaccgtagctgtcaccactggagccggatagagatcgatgacctcgccatatctgcagatcaacaattcacccaatcttggtgattgaatccagggacacaagtaggacgagctcctcattgctagatgcgtggtatggctgattcatgtgcgccgctgcagccgcctttcgcagctgctcctgccttttctgggtgtcaacaccagcagctggctgctgcttctgttctgcttttggatgctgggaggaggacgaacactgccccatctctctctctctctctctctctctctctctcgctccatccgccgaagtggacgccaccatgatctccgctcgcgccgccaccgtcgccg

SEQ ID NO: 230 - DNA, 675 bp, Sorghum bicolor
gcgcaaaatggcaagtattattaaggaaaatactgaagggtcacaccaaacaacccgcaatagctgattgatacatacaagggcggcctccatgactatttctcaacatatacatgcatggtttggaaaaacatttatttcctgaagtacacgggcttaagtgataaatttgatggtacgtggagtaatataaaatttgtaaagagactaagggtggcagtctaatttgtaggtttattggtgagttttatatatggatgacacaaacagggcctgtcagctgcatccttctttataggagagacaagaggtgatgttcaccgtagctgtcaccactggagccggatagagatcgatgacctcgccatatctgcagatcaacaattcacccaatcttggtgattgaatccagggacacaagtaggacgagctcctcattgctagatgcgtggtatggctgattcatgtgcgccgctgcagccgcctttcgcagctgctcctgccttttctgggtgtcaacaccagcagctggctgctgcttctgttctgcttttggatgctgggaggaggacgaacactgccccatctctctctctctctctctctctctctctctcgctccatccgccgaagtggacgccaccatgatctccgctcgcgccgccaccgtcgccg

SEQ ID NO: 231 - DNA, 544 bp, Triticum sp.
gcaaagcaaagcacaacgagaaggtgagaaagagagagagagagagagagagagctatggggcagtgttcgtcctcccagcacccagaagcagagcagcagaagcagcagcaggcggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaataagactgcctccattgtcgatttacgaaaatttatcacttaaacctgtcgtgtattcaacaaatgttttttgtaacgtcatgtatatttgagaaatatcacgggacgccttcgttcaaaaaaaaaaaa

SEQ ID NO: 232 - DNA, 658 bp, Zea mays
ggagaaaattaatacctgcacactaatcattcgcacattgttttataaatttattgatttctcagcacaaacgatctggtatatcatttattcatacgcacgcgtagctgtccaaagagctcggtagacacaacaggcagcggatcgagtaccaccagggaacacgcatacacggcacgatccaggtacgtatgtacggaaacagaaagtgacgccatactctgtccctgtccagtgggccttgctgctactgacacaggcacgacacgacacgtacgcggcggcggcgcaaacagaagttaactagcacgacggcacgggcaccttgcacgcggccatggccttcttgccgttgggcgagttgacgtagcgctgaagattggggtcgcgcgcgtacgtgcacaggcacggctgctgctccttgagcctactgcagcacgccgcgctgggcgacctcccgatgatgatggcgccggcgcacggcgtcagctgcgtggcgtcgcacgccgtcgccgcgtcggcgccccgcggcgcggcggcgcacagcagcagcaggaccaccgcccaggcggcgagcgccgccaacagcacctgcgaaggcttcgtcattggctgctgctagctaggtgctgcctgatggagagattcccaacacaat

SEQ ID NO: 233 - DNA, 810 bp, Zea mays
cccacgcgtccgcccacaattcggcacgaggccacgcgtcctcgcacggaggccggacgcggcaacacaccaccatccacgcactgctagtaagcgagcttagctactgatcgtcgtcaagcactctcgagctcgatctctcgaagcggctagctgctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcagggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtgtcgtgactcgtgaggcgtacctgtgtcggtagcagcatggcccactggacagggacagagtgtggcgtcgctttttttctgtttcagtacgtacgtacttggatcgcggaagcccgtgtatgcgtgttccgttgtggtgttgctgtactcgatctgctgcatgtgtgtatctaccgagctcttcggacagatacgcgtgcgtatgaataaatgatgtaataacgacgtgtgcatccgctatatatatgcatatctatacatatgcttttactattgagact

SEQ ID NO: 234 - DNA, 798 bp, Zea mays
cacgcgtcctcgcacggaggccggacgcggcaacacaccaccatccacgcactgctagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcaaggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtggggcgtgaggcgtacctgtgtcggtagcagcgtggcccactggacagggacagagtgtggcgttgctcttttctgtttccgtacgtacgtacttggatcgcgcatgcccgtgtatgcgtgttccgttgtggtgttgctgtactcgatctgctgcctgtgtgtatctaccgagctcttcggacagatacgcgtgcgtatgaataattgatgtaataacgacgtgtgcatccgctatatatatgcatatctaaaataaaaagatatcatatcttatattacgagactaaaataaaaagtaattacagcct

SEQ ID NO: 235 - DNA, 781 bp, Zea mays
gaattccattgtgttgggccaccatccacgcactagtacgtagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcaaggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtggcgtgaggcgtacctgtgtcggtagcagcgtggcccactggacagggacagagtgtggcgttgctcttttctgtttccgtacgtacgtacttggatcgcgcatgcccgtgtatgcgtgttccgttgtggtgttgctgtactcgatctgctgcctgtgtgtatctaccgagctcttcggacagatacgcgtgcgtatgaataattgatgtaataacgacgtgtgcatccgctatatatatgcatatctaaaataaaaagatatcatatcttatattacgagactaaaataaaaagtaattacagcct

SEQ ID NO: 236 - DNA, 687 bp, Sorghum bicolor
  misc_feature (677)..(677): n is a, c, g, or t
cgcactagtggtaagcaaggtagctagcgactgatcgtcgtcgagctcgctcgatctctcgaagtccgaatcagctaagcttagctaagagccatggcgacgaagcctgcgcaggtgctggtggcggtggtggtcctgctgctgctgtgcgccgccacgccgcggggcgccgacgcggcgacggcttgcgacgccacgcagctgaccccgtgcgcgggcgccatcatcggcagctcgccgcccaccgccgcgtgctgcagcaggctcaaggagcagcagccgtgcctgtgcacgtacgcgcgcgaccccaacctgcagcgctacgtcaactcgcccaacggcaagaaggccatggccgcgtgcaaggtgcccgtgccgtcgtgctaactgaacttctcttagcgccgccgccgccgctgcgtacgtgacgtgtgatgtacctgtgtcggtggcgtgggcccactggacagagacagagctagtgtgtggcgtcgctttctgtttccgtacgtacgtatacagttggatgttggatcgtgccgtgtatgcgtattccgttgtggtgttgctgtacgtatgcaccaaaaccgtgacgtaccaagctcttgggacgacagatacgtgtgtatgatgaataaatgatgtaataatatatataatgacgtatgcatccgctnatatatatgc

SEQ ID NO: 237 - DNA, 703 bp, Sorghum bicolor
  misc_feature (693)..(693): n is a, c, g, or t
accacaccaccatccacgcactagtggtaagcaaggtagctagcgactgatcgtcgtcgagctcgctcgatctctcgaagtccgaatcagctaagcttagctaagagccatggcgacgaagcctgcgcaggtgctggtggcggtggtggtcctgctgctgctgtgcgccgccacgccgcggggcgccgacgcggcgacggcttgcgacgccacgcagctgaccccgtgcgcgggcgccatcatcggcagctcgccgcccaccgccgcgtgctgcagcaggctcaaggagcagcagccgtgcctgtgcacgtacgcgcgcgaccccaacctgcagcgctacgtcaactcgcccaacggcaagaaggccatggccgcgtgcaaggtgcccgtgccgtcgtgctaactgaacttctcttagcgccgccgccgccgctgcgtacgtgacgtgtgatgtacctgtgtcggtggcgtgggcccactggacagagacagagctagtgtgtggcgtcgctttctgtttccgtacgtacgtatacagttggatgttggatcgtgccgtgtatgcgtattccgttgtggtgttgctgtacgtatgcaccaaaaccgtgacgtaccaagctcttgggacgacagatacgtgtgtatgatgaataaatgatgtaataatatatataatgacgtatgcatccgctnatatatatgc

SEQ ID NO: 238 - DNA, 748 bp, Saccharum officinarum
  misc_feature (748)..(748): n is a, c, g, or t
ccaccatccacgcactagtagtaaggtagctactgatcgtcgtcgatcgagctcgatctctygaagtccgaagcagctagctagcagccatggcgacgaagccttcgcaggtgctgctggcggcgctcgctgcctgggcggtggtcctgctgctgctgtgcgccgccgcgccgcggggcgccgacgcggcgacggcgtgcgacgccacgcagctgaccccgtgcgcgggcgccatcatcggcaactcgccgcccaccgcggcgtgctgcagcaggctcaaggagcagcagccgtgcctgtgcacgtacgcgcgcgaccccaagctgcagcgctacgtcaactcgcccaacggcaagaatgccatggccacgtgcaaggtgcccatgccgtcgtgctaacttcgttccttctgttagcgccgccgccgcgtacgtgacgtacctgtgtcaacacgtagcttggcccaccggacagggacgacagagctagtgttgcgtcgatttctgtttccgtacgtacgtatacttggatcgtgccgtgtatgcgtaytccgttgtggtgttgctgtatgtactcgatccgctgcctgtatctaccgagctcttcggacagatacgcgtgcgtgtatgaataaatgatgtaataatgacgtatgcatccgctatatatatatatatatatatatatatatatatatatatatatatatatatatatatatatatatatatatatgtggtttacctan

SEQ ID NO: 239 - DNA, 600 bp, Triticum sp.
  misc_feature (593)..(593): n is a, c, g, or t
ccaccatccacgcactgctagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcagggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaacttctgttaacgccgccgccgccgcgcgcgtacgtacgtgtcgtgactcgtgaggcgtactgtgtcggtacaacatggccactggacaggacaaatgtggcgtccttttttcggtttaatacgtastctkgatccggarccgttatctgtccgttgggtgckgwaccattgtgaatttacnacgacct

SEQ ID NO: 240 - DNA, 768 bp, Zea mays
cgcagctgagcctgtagagcacgagcgcgcccgtgagagtggaaaagagagggctggccccgccggcctgatcagatcagcggaaggcacaccgagctcttgcctgcctccactccacccaatggcgatgccgagggcgccgggcgcggggtcgctccgcttcctgggcctgctgaagcagccggagtccgacgccgccgccccattcgagctcgacgagcgcgacgtgttgtggccgacgggcggggggcagcaggacggttgggccgccccgccggcgaggcggcgtcgcgcgcacgccatgccgctgtacagcttcgggctgtcgtcgctgctcgccgaagactgcggcggtggggtgcccgtgcccgtgccggggagggcgatggcgatggcgccgagcgccgcgccgaggcagtcggcgccggtgcgcgtgccggcgccgtggccaggcggcaggagggccgacgaggacgaggaggacggcgaggaggtggtgccgccgcacgtggtcgcggcgcggcgccacgcgcggtcgtcgtccgtgctggagggcgccgggcgcacgctcaagggccgcgacctccgcagcgtccgcaacgccgtgctccggcagaccgggttcttggacctgtgaacgtccgcaggcagccatggcacaagacgccgatcgatacattgttgtgtgtctgtgtgtcgttctagcgtcccttacaagttacacatgaagaactgaactcaatacgtttcatcatccgatgggtctgc

SEQ ID NO: 241 - DNA, 770 bp, Hordeum vulgare
gccccttcttccctggcccaaatcacaaacaccgaagaagagaggagacgaaaggggatcgccgccgccgccgtcgccgaagatgacgtcgatgctgtctgcgttctcgcagtggttcgtgaacccgcgccgcaacccgctggcccgcatccacatgctcaccatctccaaccgcctcaagaactacggcctgaggtacgacgacctgtacgacccctacttcgatctggacatcaaggaggcgctcaccaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcggaaagcactgggagcccttcccctctacgagagaacccttccttgaagacattttacttgatatgcgccactgtttttgctcctcgtagcatcacaatgcatgaaataaaatgcagatcatgacactgttcctccttccggtttcatgtccattgcctgtagcagtttcctaattaatcgcgatggaatttctgttgctgttgctgatataaaagtattttttggttgatggaattgttggtataaaagtcttcaacaattccgtactcttgggcattgagaaactgattgttgttttctcttgggttcacgttatccatttctatgtacagagctgtggtgctatgttctga

SEQ ID NO: 242 - DNA, 776 bp, Hordeum vulgare
cggcacgaggcctcctcccctccccaaatcacaaacaccgaagaagagaggagacgaaaggggatcgccgccgccgccgtcgccgaagatgacgtcgatgctgtctgcgttctcgcagtggttcgtgaacccgcgccgcaacccgctggcccgcatccacatgctcaccatctccaaccgcctcaagaactacggcctgaggtacgacgacctgtacgacccctacttcgatctggacatcaaggaggcgctcaccaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcggaaagcactgggagcccttcccctctacgagagaacccttccttgaagacattttacttgatatgcgccactgtttttgctcctcgtagcatcacaatgcatgaaataaaatgcagatcatgacactgttcctccttccggtttcatgtccattgcctgtagcagtttcctaattaatcgcgatggaatttctgttgctgttgctgatataaaagtattttttggttgatggaattgttggtataaaagtcttcaacaattccgtactcttgggcattgagaaactgattgttgttttctcttgggttcacgttatccatttctatgtacararmwrwrrwrctatgttctga

SEQ ID NO: 243 - DNA, 812 bp, Gossypium sp.
gcgttcgcccagcgtccgcccacccggccccccgcccgtactaaaaaactcagatacttggtcgaggaagaaggcaaagcacagccaaaatgtcgtcgtttttgcaatcacttttggatccgaagaagagctggttagcttctttgcatatgaaagcccttaccacacgcctccgcaaatacggccttcgttacgacgatctgtacgatccttactatgacttggatatcaaggaggcgttgaatcggctgccccgtgagattgtcgatgctcgtaaccaacgccttaagcgtgcaatggatctctccatgaagcacgagtatctcccagaagatcttcagaaaatgcagacaccatttaggagctatcttcaagatatgcttgctcttgtgaagaaggagagagcagagcgagaagcattgggagctttgcctctgtatcagcgaaccattccttaagggttttcatgccgtatctcatagtcattgctgttgaaatttgcgttcgattatctgtatgtgcgtatggtatttcgatagcggaagtggactgaatttttacaattcctggtttggttggtttacacagtcatctgtgtcagtttttgaactgaatcacttatttaggtttaagtctgttggcagtgtcccaatawtaaacagaactgtgaacccgcattttacacattcawkgcmcgcaaagcrattytagaatataccagaagccctttgaacatttggattgtgtggaagcaatatttggaagacctggatgacccctggagaatcatttccttattgggtgtaggggcg

SEQ ID NO: 244 - DNA, 629 bp, Gossypium sp.
cgggcgcgtcgacgaaaataaaaaaactcagatacttgggcgaggaagaaggcaaagcacagccaaaatgtcgtcgtttttgcaatcacttttggatccgaagaagagctggttagcttctttgcatatgaaagcccttaccacacgcctccgcaaatacggccttcgttacgacgatctgtacgatccttactatgacttggatatcaaggaggcgttgaatcggctgccccgtgagattgtcgatgctcgtaaccaacgccttaagcgtgcaatggatctctccatgaagcacgagtatctcccagaagatcttcagaaaatgcagacaccatttaggagctatcttcaagatatgcttgctcttgtgaagaaggagagagcagagcgagaagcattgggagctttgcctctgtatcagcgaaccattccttaagggttttcatgccgtatctcatagtcattgctgttgaaatttgcgttcgattatctgtatgtgcgtatggtatttcgatagcggaagtggactgaatttttacaattcctggtttggttggtttacacagtcatctgtgtcagtttttgaactgaatcacttatttacgtctaagtctggtggcagtgtccac

SEQ ID NO: 245 - DNA, 633 bp, Zea mays
aaaccaaacgccgaagaagagaggagacgaaaggggatcgccgccgccgccgccgccgaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacatttttccttgatatgcgccacagcttttgctcctcgtagcatcacaatgcatgaaataaaatgcagattatgacactgttcctccttccggtttcatgtccatggcctgtagctcgtgccccttcccaaattaattgcgacagaatttctgttgctgttgctgatataaaagtttgttttggatgt

SEQ ID NO: 246 - DNA, 619 bp, Zea mays
attgtgttgggctcaaacagacaggaagcccgccgaacatcacaggctgcgaacctcctagaagctcgaggagatgctctccaagctgtcggcgtggttcgtgaacccgcggaggaatccgctcgcgcgtctccaccggaacgccgtcgcctcccgcctccgcaaatacgggctcaggtatgacgacctctacgacccgtaccacgacctagacatcaaggaggcgctggcgcggctgccgcgggaggtggtggacgcccgtaaccagcgcctcaagcgggccatggacctctccatgaagcaccagtacctacccgacgacgtccaggctatacagacgccattcaggagctacctttttgacatgcttgctcttgtgaaaaaggagagcgcagagcgtgaagcattgggagcgcttccactctaccagagaaccatcccataaagtgcctctttgcatgatccaatcaatagtgcacgcgatgatcagcagaggctgatactgtaatgtgtattgtgttttttcgaggaaatctctactacttattaagacgataagggtagcctgccgttctgacgttatacaaacttagtcatatgttctggcgttgtgcgatct

SEQ ID NO: 247 - DNA, 681 bp, Zea mays
actccatagggcgattgggatcctcgaggccggccgggaaaaactacctaacccaagcacacggcccaaacactcaaacagacaggaagcccgccgaacatcacaaggctgcgaacctcctagaagctcgaggagatgctctccaagctgtcggcgtggttcgtgaacccgcggaggaatccgctcgcgcgtctccaccggaacgccgtcgcctcccgcctccgcaaatacgggctcaggtatgacgacctctacgacccgtaccacgacctagacatcaaggaggcgctggcgcggctgccgcgggaggtggtggacgcccgtaaccagcgcctcaagcgggccatggacctctccatgaagcaccagtacctacccgacgacgtccaggctatacagacgccattcaggagctacctttttgacatgcttgctcttgtgaaaaaggagagcgcagagcgtgaagcattgggagcgcttccactctaccagagaaccatcccataaagtgcctctttgcatgatccaatcaatagtgcacgcgatgatcagcagaggctgatactgtaatgtgtattgtgttttttcgaggaaatctctactacttattaagacgataagggtagcctgccgttctgacgttatacaaacttagtcatatgttctggcgttgtgcgatct

SEQ ID NO: 248 - DNA, 851 bp, Zea mays
cgcacacgcacgccccccagagcgagaaccgagaaggacaatcgcgtcccaccgccgctgcacaagacgaggaagaggttcccggtcccggcgccgccactatgtcgtcgatgatgaacgcgctgtcaaactggctggtgaacccgcgccgcaacccgctcgcgcgcctccacatgcacgccgtctcctcgcgcctcaggaaatacgggctgaggtacgatgacctgtacgacccctacttcgacctggacatcaaggaggcgctcgggaggctgcctagggaggtggtcgacgcccgcatccagcgcctcaagcgcgccatggacctctccatgaagcatcagtacctccccgaggacctccaggcacagcaggtcccattcagaggatatttgagtgacatgttggctctggtgaaaaaggaaaacgctgagcgtgaagcactgggagcccttccactctaccagagaacgcttccctaaattgctggctaaacatggttgcaagtcttctctttacggcaaatcagaatgcatgcaataaaatgcagtgggtgttttttttgttccaaccaaagttccattttacttgtccacgcagtggtgcattgaccatgcgctctagctgttttttttcttccgattaatgggagcaaatttgtgtaacactataattaacttgtgaatcttcagctgcgggtggctgacgtagtgttctttgatcgtgattttttttgtatccattgagctttttttcgaggttgacactggctctacggccttgtattaagaactagctcagttgaatgacgagatgctgcagctagtgcaacattttttttaaagtttgag

SEQ ID NO: 249 - DNA, 753 bp, Zea mays
gaattcggcacgagggtgaagcaccgccgctgaccgctgtccccggctccccgccgccgcacaaagacgagaggaagaggttcccggcggcgccacgactatgtcgtcgatgatgaacgcgctggcgaactggctggagaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagcccttccactataccagaggacacttccttagtctttgtttgggtatagagggattgaagtggattgagatgtattgaaggggattgaaagaaaaattagttcatattacacttcaatacactacataccacctcaatccactccaatctaagattacccaaacaagcccttagggtgctggatagacatggtccaagtattctacctctttaccgcaaatcagaacgcatcaaataaaatgcagtggatgaaactgttttttttgttccaaccaaagtctaattttacttgtttatgcaatgg

SEQ ID NO: 250 - DNA, 2110 bp, Zea mays
cattgggaccctcgasrkygggggsgcacgaggcacgcccacgaccgctcctcctcttctctgccccaggccagaatcaagggagggtgaagcaccgccgccgtctccgctgccgcacaaagacgagaggaagaggttcccggcgccgccaccaccatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagcccttccactataccagaggacacttccctagggtgttggatagacatggtcgcaagtattctacctctttaccgcaaatcagaacgcatcaaataaaatgcagtggatgaaactgttttttttttgttccaaccaaagtctaattttacttgttcatgccatggtgcattaaccatgggctgtagctgttgttttcagcaaatttgtcttcaaccattattaacctgtgaaatcttcaaagagttatttcaactagcccagcaataccacaaagtggttgcagaaagggatcaagccattgcagtcaaagatagactagaatctctttgtagggagtttcagcgtcaaaacaaaatgctaaaggaagagtgccaaagggtgtcgacggagggacagaacatgcgtacggaattgtctgaaaaatttgatcatgccataaagggtgtcagtgccaaacttgaggagcagagagttgagcgcatttctcagctagaagagaacaatatgttgagaagtaaactcaaagacattgctgatcagtataacattactcagcagaaatatgctcaccaattgaaagagaaaatgatggaacttgagcttgctgatctgagacttcaacaacatcaagagaaggctgctcacgaacatacccaaatgcagttgtatgccgagcaagtttctcagcttatgactactgagaagaacctgcggttgcaactagcttcggatggagaaagatttcagcactttcaggatgccctgtcaaaaagcaatgaagtctttgaaacttacaagcaggagatggaaaagatgatttcagtgataaagaatcttaagaaggagaacgaatttctgaagggaaaatgtgagaactcagatattgctcttgtgaagctcattgaagagcgtgagctaacgaagaagcaaatagagaaattgaaaaatcaaagggagaagctcgaatccctgtgtcgaacactacaggcagaaaggaaacaaggcccctccgccagtattccagatgccccttctagccaagaagtgtcagcgacaagtcaagaatcttaacattccagttgccccttctagccaagatgtgtcagcaacaagtcaagaatcttggcagttgtgcttgtcaatataccgttggtgccagctacagcttgcggagatttctgaagcctgacattcagctgtcaacctaccgtccgtctcaggccttttgatattgtggctagagcctagtggtgcattcctactcggtgttgttaccaagcatataagctctcggctgattccatctcttgtttttgtttgagacaaagcctgctgcattggagataattagatttttgccaatcataatattgtcttcttgttataattaccactgtgtctatgaattgtgggtctagctgggtctatgaaatgtgagtctgatgacaattttacaaacttgtttcttgctgatggtaaatatcagaatctctcgctgcattgtgagtgtgttaawwaaagatacaaaatgctatagaaaaaaataaaacaaaacactcaacaatgcatgctaataaaaaatgatacaaaaggacaatagcata

SEQ ID NO: 251 - DNA, 757 bp, Oryza sativa
ctggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaaatttttcttttacatcattgtcgtaaattcttcatgtattgtgcttcacatgagaagaatgtctgttgtttgccctcgttcc

SEQ ID NO: 252 - DNA, 988 bp, Oryza sativa
tatatgggccctcctccttcgtcggcccatttggcctattacaattcacaaatctggctcatttttccgaatcctccctacgacttgggcccgagactggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaatttttcttttacatcattgtcgtaaattcttcatgtattgtgcttcacatgagaagaatgtctgttgtttgctcagaatggcttttgttttaccacctattgttttgattatgccatggttcttggtcatggttgtttgtgcagagtcgcatttgagcgattattcatgtatattgtgcttcacctgagcaaagaattgctttatgtttacaactac

SEQ ID NO: 253 - DNA, 1224 bp, Oryza sativa
gcacgaggatttaaggcttccatggagacccctcatcgccatcagagggaatacaacatatgatttggatgaagaatacaaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtgggcgaaaaaaaaaaagacacctcgcaagaaaaaagaagctactaaaagatacacctaagatgggccggcccatcggcccatcaccgtcgaatgttccacaagcttcgcggcccaaccccaaccacccaaagccaagcaaccgtacggtctcctctctcgtcaaaccaaacccaagcaaagcacccgccacatcggagaagagagagagagagagagagagcgtggaagcttctggaaggttctcgaagatgctgtcctccctgtcggcgtggctggtgaacccgcggcggaacccgctggcccgcctccacatgaacgccgtcgcctcccgcctccgcaaatacgggctccggtacgacgacctgtacgacccctaccacgacctcgacatcaaggaggccctggcgcggctgccgcgggaggtggtggacgcccgcaaccagcgcctcaagcgcgccatggacctctccatgaagcaccagtacctccccgccgatgcccaggcgaagcagacaccgttcagaggctatttatctgatatgctagcactggtgaaaaaggagagcgcagagcgcgaagcattgggagcactccccctgtaccagaggaccatcccatgaagcgtctacttcgtaggcctgtttctaattttcttgatgtatgaaagtgaattcaataaaacgcagtggacgattatgtaccatgtattatgctaaaatccttgttgtgtaatgtgttatgtgtatgcttattatgtgaagatacccaccgtcagttctccatagataccttttggtatgacaactgacatatggtgtatgttttgtaatcaatttaaaactctatatagcttcacttggagctgagtaggtaagaaagttttcattgtcgcacagaccctctgagccgtattttcctgttttact

SEQ ID NO: 254 - DNA, 1894 bp, Oryza sativa
ggtatgagccaactgcaaaaacaaaaaagaaaaagaaaaatggcgccaagattaaccgccaaacggcctgcttccctctcctctcgcggcagaaacgcagttcttcagctatggtgtggatcagagaaatggaggattctgcagagccatcgccgcctccccggcggcgtccggtgcagctccggctcgccggacagcggcggcggcggcgccccgccgctcgtcagggcggcggtcagcgccgtcaccgagctactcagggtcctgactcccaagaaccccagagttgttgatgatgatcttcagaagggagatgaaggaggaggaggagcagagttggattcgccgcgcagcgtggatgatgtgattgctgttcttgaagccgattaccagcgagcatatttcctcactgggaactttactccggacatatataccgaagattgcttgtttgaggacccgacaataaagttccgaggaaggtctagatattcccagaacctagatctgcttgtaccgttcttcgacagcccttcacttgagcttgaaaacattgaaaaggggttgagggttgaaacaaagttcatcatggcaacatggacactaaggacatatttaaggcttccatggagacccctcatcgccatcagagggaatacaacatatgatttggatgaagaatacaaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtgggcgaaaaaaaaaagacacctcgcaagaaaaaagaagctactaaaagatacacctaagatgggccggcccatcggcccatcaccgtcgaatgttccacaagcttcgcggcccaaccccaaccacccaaagccaagcaaccgtacggtctcctctctggtcaaaccaaacccaagcaaagcacccgccacatcggagaagagagagagagagagagagcgtggaagcttctggaaggttctcgaagatgctgtcctccctgtcggcgtggctggtgaacccgcggcggaacccgctggcccgcctccacatgaacgccgtcgcctcccgcctccgcaaatacgggctccggtacgacgacctgtacgacccctaccacgacctcgacatcaaggaggccctggcgcggctgccgcgggaggtggtggacgcccgcaaccagcgcctcaagcgcgccatggacctctccatgaagcaccagtacctccccgccgatgcccaggcgtgaacaagatttcgcaatcatcctcggtagttttggttcagtcccacattctgtttgtatgtatgcgaagcagacaccgttcagaggctatttatctgatatgctagcactggtgaaaaaggagagcgcagagcgcgaagcattgggagcactccccctgtaccagaggaccatcccatgaagcgtctacttcgtaggcctgtttctaattttcttgatgtatgaaagtgaattcaataaaacgcagtggacgattatgtaccatgtattatgctaaaatccttgttgtgtaatgtgttatgtgtatgcttattatgtgaagatacccaccgtcagttctccatagataccttttggtatgacaactgacatatggtgtatgttttgtaatcaatttaaaactctatatagcttcacttggagctgagtaggtaagaaagttttcattgtcgcacagaccctctgagccgtattttcctgttttacta

SEQ ID NO: 255 - DNA, 517 bp, Sesamum indicum
aggagatagtgtgagaattttcgcttgtgagtttttgaaaaagaggaaatcaacaatggcagcagctctctccaaatggcttgtggacccgaagcgcaaccctctcgctgcgctccacatgaaaaccctatccaatcgactcagtaaatacgggcttcgttatgacgatttgtacgacccgatgtacgacctggatgtgaaggaggcgctgaatcggctgccgaaagaagttgtggatgcgaggaatcagcgtcttaagcgcgccatggacctttcaatgaagcatgattatcttccggaagatcttcaggctatgcaaacaccatttaggagctatctgcaggagatgttagctcttatcaagaaagagaatgctgagcgtgaagcactcggtgcttygcccctttatcagcgtaccattccttgagtggatctctctatccatgctggggcggcctgtgattgaactacacctcatatatcatttaataagggcaactaatgcaagtcctttctg

SEQ ID NO: 256 - DNA, 519 bp, Sesamum indicum
gattgagagagagcttcagagttttagacaggcgagaagcaatggcgtctgctttaaccaaatggctcgtcgacccaaaccgcaacccgctcgccgctctccacatgaagacgctgtccaagcgcctgcggaaatacggtcttcgatatgacgatttatacgaccccatgtacgatcttgatgtgaaggaggcgctgaatcggcttccgagagagatcgtggatgcaaggaaccagcgcctcaagcgcgccatggacctctctatgaagcacgagtaccttcctgaagatcttcaggctatgcagaccccatttaggagctatcttcaggagatgctagctcttgttaagagagagaacgccgaacgtgaagcccttggtgctttgccgctttaccagcgcaccattccctgagtggactctatcttgagctgattctgatagaattgcatgtcttacaattgaataagggcaagtcatcctcgtccctttctaaaatggactataacgtgatgtctga

SEQ ID NO: 257 - DNA, 665 bp, Sorghum bicolor
atcccactccccgccgagcaccaaaacagtttggcaggacgcccgccgagcggcgagccgccgaacatcacaagcacacacgagtgacgrggccgccaaccttccagaagcttcgccaaagatgctctccaagctgtcggcgtggttcttgaacccgcgccggaacccgctcgcgcgactccaccggaacgccatcgcttcccgcctccgcaaatacgggctccggtacgacgacctgtacgacccgtaccatgacctggacatcaaggaggcgctggcgcggctgccgcgggaggtggtggacgcacgcaaccagcgactcaagcgcgccatggacctctccatgaagcacaagtacctacccgacgacgtccaggctatacagacgccattcaggagctacctttctgacatgcttgctcttgtgaaaaaggagagcgcagagcgtgaagcattgggagcgcttccactctaccagagaaccatcccataaagcgcctttgcatgatccaacagtgcacgccatggtcagcagcgtcttgtagtataatgtgtattgtttcttttcccaggaaatactatgtactattatgtttggcagcaaaaaataaaaaagacatatgttttactgacattttggtatagaagtctacatggttatgcac

SEQ ID NO: 258 - DNA, 737 bp, Sorghum bicolor
tacaaaaattcacgatcaaagaacactgcgatagctacccagcagctgctgaagatttcacaagttaataatagtcgaaggcaaatttgctcccattaatcagacgggaaaaacaacatctacagcccatggtcaatgcaccattgcatgaacaagtaaaatggaactttggttggaacaaaagaaaaacagtttcatccactgcattttatttcatgcattctgattttgccgtaaagagaagacttgcgaccatgtctatcagcactttagggaagtgttctctggtagagtggaagggctcccagtgcttcacgctcggcgttttcctttttcaccagagccaacatgtcactcaaatatcctctgaatggaacctgctgtgcctggacgtgctcggggaggtactggtgcttcatggagaggtccatggcgcgcttgaggcgctggatgcgggcgtcgatcacctccctaggcagcctcccgagcgcctccttgatttccacgtcgaagtaggggtcgtacaggtcgtcgtacctgagcccgtatttcctgaggcgcgaggagacggcgtgcatgtggaggcgcgcgagcgggttgcggcgcgggttcaccagccagttcgccagcgcgttcatcatcgacgacatggtggtcggcgccgggaacctcttcctcgtcttttgcggcggcggcgggacgcggttgccgcccggacgttccccggcccggccggc

SEQ ID NO: 259 - DNA, 668 bp, Sorghum bicolor
ggctgaaggtctgaaggacaaccgcgtcccgccgccgccgcaaaagacgaggaagaggttcccggcgccgaccaccatgtcgtcgatgatgaacgcgctggcgaactggctggtgaacccgcgccgcaacccgctcgcgcgcctccacatgcacgccgtctcctcgcgcctcaggaaatacgggctcaggtacgacgacctgtacgacccctacttcgacgtggaaatcaaggaggcgctcgggaggctgcctagggaggtgatcgacgcccgcatccagcgcctcaagcgcgccatggacctctccatgaagcaccagtacctccccgagcacgtccaggcacagcaggttccattcagaggatatttgagtgacatgttggctctggtgaaaaaggaaaacgccgagcgtgaagcactgggagcccttccactctaccagagaacacttccctaaagtgctgatagacatggtcgcaagtcttctctttacggcaaaatcagaatgcatgaaataaaatgcagtggatgaaactgtttttcttttgttccaaccaaagttccattttacttgttcatgcaatggtgcattgaccatgggctgtagatgttgtttttcccgtctgattaatgggagcaaatttgccttcgactattattaacttgtg

SEQ ID NO: 260 - DNA, 578 bp, Saccharum officinarum
cggacgcgtgggtgacgaggccgcgaaccttccagaagcttcgtcgaagatgctctccaagctgtcggcgtggttcgtgaacccgcggcggaacccgctcgcgcgcctccaccggaacgccgtcgcctcccgcctccgcaaatacgggctccggtacgacgacctctacgacccgtaccatgacctggacatcaaggaggcgctggcgcggctgccgcgggaggtggtggacgcccgcaaccagcgcctcaagcgggccatggacctctccatgaagcacaagtacctacccgacgacctccaggctatacagacgccattcaggagctacctttctgacatgcttgctcttgtgaaaaaggagagtgcagagcgtgaagcattgggagctcttcctctgtaccagagaaccatcccataaagcgcctccttgcgtgatccaacagtgcacgtgatgaaatgtagaggctgatactgtaatgtgtattatttttttcgaggaaatactatgtatattgttcagcagggaaaaaaccatactatgttttacagacattttggtatagaaggttatgcac

SEQ ID NO: 261 - DNA, 835 bp, Saccharum officinarum
accgcgttcacgcacccacgcacgcccaccacagctcctcttycctgccccaaragcraggaggtgaaggacarcgcgtcccgccgccgcacaagagggtcccggtcccggcgccgccaccatgtcgtcgttgatgaacgcgctgtccaactggctggtgaacccgcgccgcaacccgctcgcgcgcctccacatgcacgccgtctcctcgcgcctcaggaaatacgggctgaggtacgacgacctgtacgacccctacttcgacctggacatcaaggaggcgctcgggaggcttcctagggaggtggtcgatgcccgcatccagcgcctcaagcgcgccatggacctctccatgaagcaccagtacctccccgagcacctccaggcacagcaggttccattcagaggatatttgagtgacatgttggctctggtgaaaaaggaaaacgccgagcgtgaagcactgggagcccttccactctaccagagaacacttccctaaagcgctggctagacatggtcgcaagtcttctctttacggcaaatcagaatgcatgaaataaaatgcagtggatgaaactgttttttgttttgttttgttccaaccaaagttccattttacttgttcatgcaatggtgcattgaccatgggctgtagctgttgttttcccttctaattaatgggagcaaatttgtcttcaatcattattaacctgtgaaatatattcagctgctggatagctatcgkagtgttctttgatcggggattttttgtattacttggaccttatttttttactttatggtaattgcaaagcttgaatttttgtggtgg

SEQ ID NO: 262 - DNA, 810 bp, Nicotiana sp.
gggagacaaaaaggaaaatccctaatcttttgttagcagagacacattgcgatcgaacaatggcatcgacgttctcgaaatggctggtggatccaaagaagaaccctctcgctgcaatccacaagaaatccctctccgctcgcctccgtaattacgggcttagatatgatgacctgcatgatccaatgtacgatttggacgtgaaggaggctcttaatcgccttccaagggagattgttgatgccagaatccagcgccttaagcgtgcaatggacctctcaatgaagcaccaatacctcccagaagatctccaggcaatgcaaacgccatttaggagctatcttcaggaaatgctagctcttgttaaaagggagagagcagaacgtgaggctctgggagctttgcctctctatcagcgtacaattccatgaagaaatcaaatctcccttgaagctttttcgattgagaataactactgtgttgcttgtagatgagctttgcctctctatcagcgtacaattccatgaagaaatcaaatctcccttgaagtttttcgattgagaataactactgtgttgcttgtagatctccatgacggatatagaaatatattctgcaggaaaaacatgtgcgctttttatgatcaaacacttcaagttagtcgtcctgtgggcttggtttttgtattcgtatatttctttatatgggacgtacatttcactagaactcccatattactctggttggattgctttgacaggttttattggtgtttccaagtacacatgaaaggaaacataattttgcttt

SEQ ID NO: 263 - DNA, 850 bp, Nicotiana sp.
ggccattacggccggggcccttctagagacaaaaaggaaaatccctaatcttttgttagcagagacacattgcgatcgaacaatggcatcgacgttctcgaaatggctggtggatccaaagaagaaccctctcgctgcaatccacaagaaatccctctccgctcgcctccgtaattacgggcttagatatgatgacctgcatgatccaatgtacgatttggacgtgaaggaggctcttaatcgccttccaagggagattgttgatgccagaatccagcgccttaagcgtgcaatggacctctcaatgaagcaccaatacctcccagaagatctccaggcaatgcaaacgccatttaggagctatcttcaggaaatgctagctcttgttaaaagggagagagcagaacgtgaggctctgggagctttgcctctctatcagcgtacaattccatgaagaaatcaaatctcccttgaagctttttcgattgagaataactactgtgttgcttgtagatgagctttgcctctctatcagcgtacaattccatgaagaaatcaaatctcccttgaagtttttcgattgagaataactactgtgttgcttgtagatctccatgacggatatagaaatatattctgcaggaaaaacatgtgcgctttttatgatcaaacacttcaagttagtcgtcctgtgggcttggtttttgtattcgtatatttctttatatgggacgtacatttcactagaactcccatattactctggttggattgctttgacaggttttattggtgtttccaagtacacatgaaaggaaacataattttgctttamcttttcattttgttc

SEQ ID NO: 264 - DNA, 572 bp, Nicotiana sp.
gggaaatccctaatcttttgttagcagagacacagtgcgtgtgggtgtgtgttttacgatcgaacaatggcatcgacgttctcgaaatggctggtggatccaaagaagaaccctctcgctgcaatccacaagaaatccctctccgctcgcctccgtaattacgggcttagatatgatgatctgcatgatccaatgtacgatttggacgtcaaggaagctcttaatcgccttccaagggagattgttgatgccagaatccagcgccttaagcgtgccatggacctctcaatgaagcaccagtacctcccagaggatctccaggcaatgcaaacaccatttaggagctatcttcaggaaatgctagctcttgttaaaagggagagagcagaacgtgaggctctgggagctttgcctctctatcagcgtacaattccatgaagaaatcaaatctctcttgaagctttttccatcgagaataactactgtgttgcttgtagatctccatgcatggagatagaaatatattctgtgggaaaaccatgtagtacgccttctataatcaaacacttcaa

SEQ ID NO: 265 - DNA, 843 bp, Triticum sp.
ctactaacaagaaggagatgccctggcaacagcaggaagtagaagtgtataccctgcttcgtcagcaggctgcgagcggcggccgtcagcaggagcagcgacagcgccagctccttcttgtattccccttcccctctcctctcctcttcggcggcggcggcttcagaaagagtcgagaccgagcgaggggatcgccgccgccgccgccgccgtcgcccaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtatgacccctacttcgatctggacatcaaggaggcgctctgcaggctgccccgggaggtggtcgacgcccgccaccagcgtctcaagcgcgccatggacctctccatgaagcaccagtacctccccgacgacgtccgggcactacagacaccattcaaaagctatttgagcgacatgctggctctggtgaaaaaggaggcagcagagcgtaaagcactgggagcccttcctctctatgagagaacccttccttgaagacatcttccttgatatgcgccacagcttttgctccttgtagcatcacaatgcatgaaataaaatgcagattatgacactgttcctccttcgggtttcatgtccattgcctgtagcagtttcttgtgccccttcccaaattaattgcgacagaatttccgttgctgttgctgatataaaagtttatttgggttgatggaattgttgctatagaatctgaaaatctgccctgggctttttc

SEQ ID NO: 266 - DNA, 819 bp, Triticum sp.
  misc_feature (799)..(799): n is a, c, g, or t
ccacgcgtccgccacctcctcctcccctccccaaatcacaaacgccgaagaagagaggagacgaaaggggatcgccgccgccgccgccgccaccgcccaggatgacgtcgatgctgtccgcgttctcgtcgtggttcgtgaacccgcgccgcaacccgctggcccgcatccacatgctcaccatctccaaccgcctcaagaacttcggcctgaggtacgacgatctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacttcttttcatgatatgcgccacagtttttgctcctcgtagcatcataatgcatgaaataaaatgcagattatgacactattcctacttccggtttcatgtccattgcctgtagcagtttctcgtgcccattcccaaattaattgcgacagaatttctgttgctgttgctgatataaaagtttattttggttgacggaattgttgctgtagaagtctgaacaactctctgctcttgggacttttccgttgagcaactgttttgttgtttgcttctgggtttacgcttcccatttctacagagctatggtgctantgatctgctatgttccctga

SEQ ID NO: 267 - DNA, 816 bp, Triticum sp.
cgctcctacgaccccggcccaagagggaaaccacaaccaccccacctcccctcctcctcctccccaaatcacaaacaccgaagaagagaggagacgagaaaggggatcgccgccgccgccgccgccgtcgcccaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtatgacccctacttcgatctggacatcaaggaggcgctctgcaggctgccccgggaggtggtcgacgcccgccaccagcgtctcaagcgcgccatggacctctccatgaagcaccagtacctccccgacgacgtccgggcactacagacaccattcaaaagctatttgagcgacatgctggctctggtgaaaaaggaggcagcagagcgtaaagcactgggagcccttcctctctatgagagaacccttccttgaagacatcttccttgatatgcgccacagcttttgctccttgtagcatcacaatgcatgaaataaaatgcagattatgacactgttcctccttcgggtttcatgtccattgcctgtagcagtttcttgtgccccttcccaaattaattgcgacagaatttctgttgctgttgctgatataaaagtttattttggttgatggaattgttgctatagaagtctgaacaactctgctcttggtcttttttccattgagcaacgtttttgttgcttgcttctgggtttacgctgcccatttcgac

SEQ ID NO: 268 - DNA, 1223 bp, Triticum sp.
attcggcaccaggtgacgaggagggggaggcgagtgagacgggacaagaaaagccatggcagaacctacagtgaggaaagccatggctctctagcaagcacgcagcgagcaagatgatggcgggcaacgacggcatcggacgatggcttgcggagacggatggagaggcagagcaccggggctgactcctctcccgccgcgagaccgtggagaaggagggagccgacctccgtcgctccacgcacctgaagacggctcagatcgggaaccaccactgcagcctgaagacgagcgatgggcaggtaaggaggaggaagaggcgaggcggtggaggagtagcagtaggcggcggggctcctagggcataggaggaggaggtgggagggagtggcggcagacgagggagggaggagacgaaaggggatcgccgccgccgccgccgccgccgcccaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacattttccttgatatgcgccacagcttttgctcctcgtagcatcacaatgcatgaaataaaatgcagattatgacactgttcctccttccggtttcatgtccattgcctgtagcagtttctcgtgccccttcccaaattaattgcgacagaatttctgttgctgttgctgatataaaagtttattttggttgacggaattgttgctatagaagtctgaacaactctgctcttgggccttttccgttgagcaactgtttgttgtttgcttccgggtttacgctgccyatttctacagagctrtggtgctagtgatctgctatgtgctgtgaattgttcttccgagcttgcctagagatgtttctctctcaaagttmtacagtggag

SEQ ID NO: 269 - DNA, 422 bp, Triticum sp.
cggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattatagcgtgaagaactgggagcccttccccttcaccagaggacccttccctgaagtcttatcttgatag

SEQ ID NO: 270 - DNA, 979 bp, Hordeum vulgare
cggcacgaggattcccctcccctctcctctcctctcctcgcatccatcggcctcccgatctctcccacaccgcgcacgacgtccggcgccgatcaaccaaccaaccgaccagccagccagcccggacgcctctggccgcgcgtgcgtgcgtgttcgacataccatggcgcagcgggaccacaagcaggaggagccgacggagctgcgggcgccggagatcacgctctgcgccaacagctgcggcttccccggcaacccggccacgcagaacctctgccagaactgcttcctggccggcccggcgtccacgtcgccgtcctcctcctcctcttccctaccgggcgcgtccgtgtcgacccccgtgctcgacaggccgaggcccgcgccggtggacgcggagctggcgcaccccgccgtcgactaccgcgctacggcgacggaggcgaagccggcgaggacgtcggtgaaccggtgctccagctgccggaagcgggtcgggctgacggggttccggtgccggtgcggcgacgtgttctgcggcgagcaccggtactcggaccggcatgggtgcagctacgactacaaggccgccgccagggacgccatcgcccgggacaaccccgtggtgcgcgccgccaagatcgtcaggttctgagcagaaaaaggatcaagaattcggaattccagccggggccaagacaggaatcatctcaacgaaaacccaagccgccgtggtccggccgtgcgccgtgcgctagtattatgctgttgttcttcggagtgtttccctttaagaaaaaaagaaactttatttattggaaatgggcggtaaaagatgtggacgggaaggaaagaatagcgtgtgtaatatcgacgggtggttgaggcggaggagccagcaatgaaatggattggatatgtgtatgtgtatgtgaactttccacattattcaatgcggctgtcccatttgcatttgacc

SEQ ID NO: 271 - DNA, 1055 bp, Zea mays
cctccctccctcccgcgcggatcacagacaggctcacggtcacggccggcctcccaattcgcaacctcgcctccgcctctcctcctacccctccgaaaaagcaagcttcggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtactaagcttctcgccg

SEQ ID NO: 272 - DNA, 1068 bp, Zea mays
gacgagaagcttagtactagtataatagttctgtccaaagttgcgtgtgacacatacatacacctaacccaatcaccaacccatctgttcatcgtttcgggccctcaacccactgcaccaccaccattattattactccactattcttcgtccacctcttctcctcccaatcccatacccataggacaaatattttttttttaaaaaaaaaggagattaaaatcaaaggaacagcgtaataataataacaccgaagaccttgtctgcacgccttcctcctccccttctccgccctgcgagcctttgtgttgtgtccttccttcccgccgtggatcagaacctaacgaccttggccgcgcgcaccaccgggttctcccgggcgatggcgtcccgggcggcgcccctgtagtcgtagctgcagccgtgccggtccgagtaccggtgcgcgccgcagaagagctcgccgcagcggcaccggaaccccgtcagccccacgcgcttccggcagctggagcaccggctcgcggacgccctcgccgcggcttccgtagcctggcccacggccgcggccgccggagcggccagcgcctccaccgctgccgcgtctacgacgagcgctgctggcctcggctgcgacgccgcggacgccagggaagaggaggaggaggtaggggacgacggcgacctcgacgccgagaagcagctctggcacaggttctgcgtggccgggttacccgggaacccgcagttgttggcgcacagcgtgatctccggcgcccggagctccgtgggctcctccttcttgtcgcgctgcgccatggctcctcgtgcgcctggcagaagggagaccccgaaccaccgtgcgtctctcactctgtctgtctgtctgtctgtctgtgtgtgggagcgcgtgcacgcgcgcgcggtggtggtggtggcggcccggccgaagcttgctttttcggaggggtaggaggagaggcggaggcgaggttgcgaattgggaggccggccgtgaccgtgagcctgtctgtgatccgcgcgggagggggggagggagcgcggagc

SEQ ID NO: 273 - DNA, 1451 bp, Zea mays
  misc_feature (1386)..(1386): n is a, c, g, or t
ccggccggggaggccgaggccggaaaaacacgccgggcgggcgggtcactgctactgcctttgccgctgcgcgtccgcggaaggggacgcgtccccgtccgtcttcccacttttccccgataaaaccacgggcgcctctcgtccattcctcgctcgcccaccctccccgcggatcacagacagcctgtgcccgccttccagtccacaatctccctgcctctcctctcccaccctccgaaaagcaagctccggccggaccgccccaccgcgcgcgcgcatacacacacacagagagagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgcagccgtcccctacctcctctccctcagcttccgcgccggccgccgcggtgccgcagccgaggccggcgctcctggacgcggcgctgcagctggcgcctccggccgcggccgcgggccagcctgtggaggcctcggccaggacttctgccaaccggtgctccagctgccggaagcgcgtggggctgacggggttccggtgccgctgcggcgacctgttctgcggcgcgcaccggtactcggaccgccacggctgccgctacgactacaggggcgccgcccgggacgccatcgcccgggagaacccggtggtgcgcgcggccaagatcgttaggttctgattcgaccggcgggcggaggaaggaattgcagagagggaaaacgaagattccaagggcggaaggggggaaaggcatgcgaaatcagagaggtcttcggtgttactactatgatgttcttggacgtgtttgatttttaatctccttttatatatatatatatatataattttcctacggaggtgggaggagaggaggtggacgaagaatagtgtaatgataatggtggtggtgcagcggcggtggttgagggcccaaaacgatgaacacatggggttgggttgggtgtatgtatctgtcacacgcagcttttgtgcaagactattatactacatcgctggtccctccaatttgctcaaaaaaaaaaaaaaaaaaatccgaggggaggaaggtacccaacccaaaggcttgcagtcgcagggcggagaaggggagaaggaaggggttcggacaaggttttcggtgttaatattaatacgcctcctttgattttaatccccttttttaaaaaaatatttgtcctatgggaatgggattgggagaanaggtggacgaaaaaaagtggactaataataatggtggtggtcaagtggcggtggtttaggccccg

SEQ ID NO: 274 - DNA, 859 bp, Oryza sativa
  misc_feature (528)..(528): n is a, c, g, or t
cgccatcgtcgtacccgggaatcggccattatggccgagggcctcgctaacccattcccaaaagcaaagcgaacctacgctcgcttcgtctctctctcggattcgatcatggcgcagagggagaagaaggtggaggagccgacggagctgagggcgccggagatgacgctctgcgccaacagctgcgggttcccgggcaacccggcgaccaacaacctctgccagaactgcttcttggctgcctcggcgtcttcttcttcttcttccgccgctgcctcgccgtcgacgacgtcgttgccggtgtttccggtggtggagaagccgaggcaggccgtacagtcgtcggcggcggcggcggtggcgctggtggttgagcggccgacggcggggccggtggagtcgtcgtcgaaggcgtcgaggtcgtcgtcggtcaaccgatgccacagctgccggaggcgggtgggcctgaccgggttccggtgccgctgcggcgagctctactgcggcgcgcaccggtactccgaccgncacgactgcagcttcgactacaagtcggcggcgagggacgccatcgccagggagaaacccgtctgtcgcgccggcaagaatcgtaagttctaacagggtcttcccggggaaaccaccctgaatttccccctttttcttctttttcctcttcttcccttaaactaacgtgagcactaatcacgttcctgaagctctaagggcaggcaacacgaaagagaaggagaaaggttcaactctagggaacacagatagtagtaggaaacaagataaagtagagtgtatggttgatataaaggagtgaatggaggatatataaagaataaatgctagt

SEQ ID NO: 275 - DNA, 1222 bp, Sorghum bicolor; identical to SEQ ID NO: 12

SEQ ID NO: 276 - DNA, 1013 bp, Sorghum bicolor
ccatttcccaccttcacctcaccagaggccaggccagccgggcggcgtagctacctgcctctgcttctccctctccccgcacagaggctcctagctgccgtgccgccgcgtgacagctccttctctctagtctctacctagctacctctcgtgtcatggcgcagcgcgacaagaaggtggaggagccgacggagctgcgggcgccggagctcacgctgtgcgccaacagctgcggcttcccggggaacccggccaccaacaacctctgccaggcctgcttccaggccgccacggcttcctccgcctcagcctccgtctcgccgccgtcgccttcctcctcgttgtctccgtccccggcggtgttcaagttcgacgagcagcagcacgcgaggccgtctgcgacggcggtgttcgccgaccggcctgcggagcaaccgccggcgccggcgtccgccaggccgatccggacgacgtcgacttcgtcgtcgtcgtccgtcaaccggtgccagagctgccggaagcgcgtcgggctgacggggttccggtgccgctgcggggagctcttctgcggcgcgcaccgctactcggaccgccacgactgctgcttcgactacaaggccgtcggcagggacgccatcgccagggagaaccccgtcgtgcgcgccgccaagatcgtcaggttctgatctgtggtcccgtctcggagcgacaaccagcggcggcggcgtctcgatcggagccggacggacgggcggaggacacacggtggtgatctcggcggagattcggtggatcggtccatctccctctagaattccttccctcctctcttctattttttttccctctcttttcttgctttgtttttctttttttttctattattgttacaagataaaaaattagaaagtgatcgatccatggagggtgttggttattactcattgtcacgctgttcttgacaattataccatccatgaccttgaggaggaggaggaagaaaagcgttggcc

SEQ ID NO: 277 - DNA, 1359 bp, Sorghum bicolor
gcacgagggctgcgcttgcgcgtccgcggaaggggacgcgtccccgtcttcccacttccccccccgataaaaacccgggcgcgcctctcgtccattcctcgcggaactcgctcccctccccgcggatcacaggctcaccacccaattcgcaagctcccccccctcctcctccgtctttcccccaccctccgaaaagcaaggtccggccccgggccgcccgcgcgcgcgtacacacagacacagacacaggcacaggcacggttgttcgttcgggttccttttgccaggtgcacgacgagcatggcgcagcgcgacaagaaggaggagcccacggagctccgggcgccggagatcacgctgtgcgccaacaactgcggcttcccggggaacccggccacgcagaacctgtgccagagctgcttctcggcggccacggcgtcgaggtcgtcgtcgccgtcgtcccctacctcctcttcctcagcttcagcggtgtcgcagccgaggccggcggcactcgtagacgcagcagcggtggagctgctggcctctgcggatgccgcagccgtgggccagtctatggaggtcgtcgccgccgctccggcggccacggcggcgaggtcgtctgctgtgaaccggtgctccagctgccggaagcgggtggggctgacggggttccggtgccggtgcggcgagctcttctgcggcgcgcaccggtactcggaccgccacgactgctgcttcgactacaaggccgtcggcagggacgccatcgccagggagaaccccgtcgtgcgcgccgccaagatcgtcaggttctgatctgtggtcccgtctcggagcgacaaccagcggcggcggcgtctcgatcggagccggacggacgggcggaggacacacggtggtgatctcggcggagattcggtggatcggtccatctccctctagaattccttccctcctctcttctattttttttccctctcttttcttgctttgtttttctttttttttctattattgttacaagataaaaaattagaaagtgatcgatccatggagggtgttggttattattcattgtcacgctgttcttgacaattataccatccatgaccttgaggaggaggaggaagaaaagcgttggccaaaaagaaagaaaagaaaagaaaagtcatgggaggcagagaagaaggtggggatgaaaagaagagagcgatgataatgttattgtagcggtggtggttgggtggaggcgggaaagaagcgatagggtaaccttcggtttggtgtgttgtcctgcttcaatcacaaatctctatatactttttatatatacccttgtataaaattataaagtta

SEQ ID NO: 278 - DNA, 1160 bp, Sorghum bicolor
gacgagaaacgtactcgtagtataatagtttttgcacaaagttgcgtgtgacagatacatacacccaacccaacccaacccatttgttcatcgttttgggccctcaaccaccaccaccaccattattattacactattcttcgtccacctcttttcctcccattcccgtaggaaaattatataaaaaaaaaggagattaaaaatcaaacacgttcaagaacagcataataataacaccgaagacgaactttctttcatctgcatgcatgcctttaccccttccgccctttggatggatctcccctctgcaatctcttcctccgcctgtccgccgtcgtcgatcagaacctaacgatcttggccgcgcgcaccaccgggttctcccgggcgatggcgtccctgccggcgcccttgtagtcgtagctgcagccgtgccggtccgagtaccggtgcgcgccgcagaagagctcgccgcaccggcaccggaaccccgtcagccccacccgcttccggcagctggagcaccggttcacagcagacgacctcgccgccgtggccgccggagcggcggcgacgacctccatagactggcccacggctgcggcatccgcagaggccagcagctccaccgctgctgcgtctacgagtgccgccggcctcggctgcgacaccgctgaagctgaggaagaggaggtaggggacgacggcgacgacgacctcgacgccgtggccgccgagaagcagctctggcacaggttctgcgtggccgggttccccgggaagccgcagttgttggcgcacagcgtgatctccggcgcccggagctccgtgggctcctccttcttgtcgcgctgcgccatgctcgtcgtgcacctggcaaaaggaacccgaacgaacaaccgtgcctgtgcctgtgtctgtgtctgtgtgtacgcgcgcgcgggcggcccggggccggaccttgcttttcggagggtgggggaaagacggaggaggaggggggggagcttgcgaattgggtggtgagcctgtgatccgcggggaggggagcgagttccgcgaggaatggacgagaggcgcgcccgggtttttatcggggggggaagtgggaagacggggacgcgtccccttccgcggacgcgcaagcgcagccctcgtgc

SEQ ID NO: 279 - DNA, 1172 bp, Sorghum bicolor
gcacgagggctgcgcttgcgcgtccgcggaaggggacgcgtccccgtcttcccacttccccccccgataaaaacccgggcgcgcctctcgtccattcctcgcggaactcgctcccctccccgcggatcacaggctcaccacccaattcgcaagctcccccccctcctcctccgtctttcccccaccctccgaaaagcaaggtccggccccgggccgcccgcgcgcgcgtacacacagacacagacacaggcacaggcacggttgttcgttcgggttccttttgccaggtgcacgacgagcatggcgcagcgcgacaagaaggaggagcccacggagctccgggcgccggagatcacgctgtgcgccaacaactgcggcttcccggggaacccggccacgcagaacctgtgccagagctgcttctcggcggccacggcgtcgaggtcgtcgtcgccgtcgtcccctacctcctcttcctcagcttcagcggtgtcgcagccgaggccggcggcactcgtagacgcagcagcggtggagctgctggcctctgcggatgccgcagccgtgggccagtctatggaggtcgtcgccgccgctccggcggccacggcggcgaggtcgtctgctgtgaaccggtgctccagctgccggaagcgggtggggctgacggggttccggtgccggtgcggcgagctcttctgcggcgcgcaccggtactcggaccggcacggctgcagctacgactacaagggcgccggcagggacgccatcgcccgggagaacccggtggtgcgcgcggccaagatcgttaggttctgatcgacgacggcggacaggcggaggaagagattgcagaggggagatccatccaaagggcggaaggggtaaaggcatgcatgcagatgaaagaaagttcgtcttcggtgttattattatgctgttcttgaacgtgtttgatttttaatctcctttttttttatataattttcctacgggaatgggaggaaaagaggtggacgaagaatagtgtaataataatggtggtggtggtggttgagggcccaaaacgatgaacaaatgggttgggttgggttgggttgggttgggtgtatgtatctgtcacacgcaactttgtgcaaaaactattatactacgagtacgtttctcgtctc

SEQ ID NO: 280 - DNA, 745 bp, Zea mays
attgtgttgggcgtgagcacctgtgcccgactcaaccaatctactcgctgctacaacagagtttgcctgttgccttgcttccacctcccggctgcagctgcacctgctgctcgatcggatcggccgcgcgcggcatgtcgaccaccacccccaccaacgccgcctcccagcaggtatgtacgctgtacgcaactacagtaatcgtcagatcatcgtttgattaggaattatcgcctcccagcagggcgacgacgctgcggctggccgcgcggacaagaagccggcgcaagagacggtgacgaagacggtgcagacggtggaggtgcggtcctcggcagggcagcccgacgaggagggcgtgctcaagcccgtgaaggtggtgcacgagatccccgccaaggacagctccggcgtcaagcaggactaggactagctaagctgcctagctcgatcgatcatctagctaggatcgatgctgctgctgctaagctgagtggatttgatgctgctgcggtcagaaatcttatcgtcatttccaccccccaaccagatcctagctagtaattgcaaataaacaaatgttgcgttggatcctaatgtgaattagtgatctgtgcggcctgccgcttcatttgtaaacatgtactaataagacgcctgattttgtgttcgacacgatttgttgatcaagcgtcctaccgtttctcgagtatcccgttgagaaaataaacagttttttaaatcg

SEQ ID NO: 281 - DNA, 651 bp, Sorghum bicolor; identical to SEQ ID NO: 14

SEQ ID NO: 282 - DNA, 1047 bp, Zea mays
attgtrtyggkcgccgtctccagcagagaagaagaagcgacacagctcaactgctcaaggacagcgcagcacgcaagcgggacctcaccgaagcagcacacagcacacaagatcgcacatcctactgctgcgccgcacaatgggcatctgcgtgtcgtgcgacgcggcggacgagggcgccgcgacggcgagggtggtgctccccagcggcgagctccgggagtacgccccgccggccacggccgggacggcgctgcaggcggccggcggcgagggcccctggctcctctgcgacgccgacgggatggcgttcgagggccccgtcgccgtcgcggcggtcgcccccggcgaggagctccaggcggggcagatctacttcgtgctccccgccgagatgcggcgccgccgcctcacccgcgaggaggtcgccgcgctcgccgtcagggccagctcggcgctcgtcaaggccgcgcagccgtcctcgccctgccgccggctccggcgcggcgcggtggcgccgctcgtgttcccggtcccagaggaggagtacgcggcggcggacgcggtctcgcccgtcgcgcggcgaagccgcaccagaagcggagggtggcgtgccggggcgggagggcgtccaggttctcccccgacctgaccgcgatcccggagagcgagtagatcgagcctccgctcggcatgtgatatgtctctggtggtcagtggtgacgggtcgctcgccggcgcttggtcggacggtgtggccgcgccggagcggagatcgacggtgcgggaagtgttgtagatgcagarctcagaaatgagaaatgtgagtaggtgtttttggcgcggcggcaacaggatgcgcgtgtagagtgtacgttacgtgtaggtttaggtgcatgcaagtgtaaatacacgggatctccgtgcggtgtgcccagtcacagtttggaactcagcttttattagtgctcgtgttcaggctytgtgtcgtgcatcatggaataaatctctccttgtttgtgaaaaaggaaatctctccttgtcgcc

SEQ ID NO: 283 - DNA, 1026 bp, Sorghum bicolor
cgccatctccgcggagaagagaagcagctcaaggacagcgccgcccgcaagccacaccgaccggccggccggaccgaagcagcagcatacactgatacactcactgcacaatgggcatctgcatgtcgtccgacgcggcggacgagggcgcggcgacggcgagggtggtgctccccagcggcgagctccgggagtacgccccaccggccaccgccgcgacggcgctgcaagcggcctccggcggcgacggcgaggggtcgtcgtggttcctctgcgacgccgacgggatcgcgttcgaggggggccccgtggccgtggccgcggtcgcgcccggggaggagctccaggcggggcagatctacttcgtgctccccgccgagatgcagcgccgccgcctcacccgcgacgaggtcgccgcgctcgccgtcagggccagctcggcgctcgtcaaggccgcagccgcccagccgtcctccccgtgccgccggcgccggcgcggcgcggtggcgccgctcgtgttcccggtccccgaggaggagtacgcggcggcggaaccggtttcgcccgtcgcggcgaagtctgccgtggcggcggcgcagaagcggagggtggcgtaccggggcggcagggcgtcgaggttctcccccgacctgaccgctatcccggagaccgagtagaccaagcctccactccacccggcatatgtgtctctctggtggtgacgagtcgctcgccggcgcttggtcggaccccggccgcgcgcgccggagatcgatggagcagggaagtgttctagacgcgacgcagagctcagaaatgagaaatgtgagtagtgtttttttggcgccgttggtttacgcggcaggcaacagagagtgtacgttacgtgtaggttttagatgcaagtgtaaatacacggaatctccgtacggtgtgcccagtcacagtttggaactcaagcttttattagtgctcgtgttcaggctctgtgtcgtggatcatcaatcatcatggaataaatctctc

SEQ ID NO: 284 - DNA, 1183 bp, Zea mays
gaattccattgtgttggggctaccataccaaagccactttctttctccatcactccagccatccccaaccccaactcccttcactgtatatatgatacatccatccaccattcgtgaggacagcagcatctgtgcgtctcttccacgagaggcaacctaccgtatagtactgccgacatggtgctctccggcggcctagtcgtgccgtggctcgcggcggcggtccgtggctcgcggcggtggccgcgctggccatcaccgccgccccgstcggcgccgatgcctacaagaactacaccgtcggcgatgacaagggctggtacgacggcctcagcctgcccggggtcgactaccaggcgtgggctgacggcaagaacttcagcctcggggatttcctcatcttcaacacggacaagaaccactcggtggtgcagacgcggaacgtgacgctgtacgagagctgcgactacaacgactcggggcccgacgacaccgtcgagtgggtcgccgcgccgccggagttcagcaaggacgccgtcaccgtcgccgtgccgctcctcgacgagggccgcgcctacttcttctcgggcaactacgacggcgagcagtgcgagagcggccagcgcttcgccgtcgacgtggcccacggccagggcctgccgcctgacctcaggccgcccgtcgccgacgcgccggcgccctcctccgcggggcccgccgacggcgccgccgcgctcgacttcagccaccccaagaacgtcaccacgccgagcgcgacggacgatgacgacgagcaactgggcggtggctcggcctcctccagcctcaggtccgctctgcccgtgaccgcgacgctgctcatcaccttgctcttcgcgttcgcggtgtaggtggcatgcgttagtttcgcttttgtttgtgctgctgctgcttgggcctcataatttgtttgtttaatgcactagtacagttgaagggtttctctgtatagggagagagatgagatatgtttagtgctgtagtagtgtagttgttagtgaaatgctttcacttgtatattctggctgtttatttggtccgtaccgtgctccgtagtaatggatctcgataaaataataattatctcattctttggaaaaaaacacaaaaacccaccgatacaaatcccacaaaaggcccctta

SEQ ID NO: 285 - DNA, 709 bp, Zea mays
ggcacgaggagcacgcagcgcagcactgaagcaccacttcctgcactcactgtgctagctgctcaaaccgtagtagtaacagtccatcaccaccaatggctcccaaggttgcgctcttccttgccctgagcctcctgtttgctgccaccgcgcatggctgcgaacccaactgttctggcccagtcgtcccaacgccgccagtcgtgccgactccgtcgtcgcacagccacgggcgctgcccgatcgacgcgctcaagctcaaggtgtgcgccaacgtgctaggcctcgtcaaggtcggcctaccccagtacgagcaatgctgcccgttgctggagggtctggtggacctcgacgccgcattgtgcctctgcaccgccatcaaggccaacgtcctcggcatccacctcaacgtgccccttagcctcaacctcatcctcaacaactgcggcaggatttgcccagaggacttcacttgccccaactaagcttgggatcccttgtgtgctccatctcgcgattctatttacgagcatgtcggcctcttgcaatattagcgaataagtttgtcgtttcaaattctttcgctgtaccatcgacgattgtatttgtgtggagttatatttgaaattttaatgatcaataagaaatattcgtgttttttattttgagaaaaaaaggagatatgaatcattcagttttagtgaactcg

SEQ ID NO: 286 - DNA, 603 bp, Zea mays
gatcccaaagagcaagagcacgcagtagtgcagcagcactgaagcactacttcctgcactcactgtgctagctgctcaaaccgtagtagtaacagtccatcaccatcaccatcaccaccaatggctcccaaggttgcgctcttccttgccctaagcctcctgttcgctgccaccgcgcatggctgcgaaccctactgttccggcccagtcgtcccaacaccaccagtcgtgccgactccgtcgtcgcatagccacgggcgctgcccgatcgacgcgctcaagctcaaggtgtgcgccaatgtgctgggcctcgtcaaggtcggcctaccgcaatacgagcaatgctgcccattgctggaagggctgggggacccttgaccccgaattgtgcctctgcaccgccatcaaggcaaacgtcctcggcatccacctcaacgtgccccttagcctcaacctcatcctcaacaactgcggcaagatttgcccaaaggactttacttgccccaactaattgagctgaatatggagataaagccagcatccaaggaatgtaccccttagtgttccatctcgcgattccgattgttacttgatcatcatcgc

SEQ ID NO: 287 - DNA, 771 bp, Zea mays
tatcgaattccattgtgttggggccgcacgcagcgcagcactgaagcaccacttcctggcactcactgctagctgctcacaccgtgctagtaacagtccatcaccagtcaccaccaatggctcccaaggttgcgctcttccttgccctcgggccttctcttcggtgccgccgcgaatggctgcgaaccctactgtcccggcccagtcgtcccaacaccgccagtcgtgccgacaccgtcgtcgcacagccacggacgctgcccgatcgacgcgctcaaactcaaggtgtgcgccaacgtgctaggcctcgtcaaggtcggcctgccccagcacgagcaatgctgcccactgctggaggggctggtggacctcgacgccgcactgtgcctctgcaccgccatcaaggccaacgtcctcggcatccacctcaacgtgccccttagcctcaacctcatcctcaacaactgcggcaagatttgcccggaggacttcacttgccccaactaattgagctgaatatgaagataaaaccagcatccaaggaatgtaccccttaatattcgatctcgcgattccgattgtgacttgatcatcatcactgtttatctatttttatattttatacttaattatcaataagaaacattcacattttttgttttgagaaagagggcaaaatatgtgcaccattactgttttagaacaatcgtgttctctgtctccctgaggagttttccgggaggtatctataagacagaccgagcgttgatc

SEQ ID NO: 288 - DNA, 799 bp, Zea mays
cgggcaggtacgcggggatcccaaagagcaagagcacgcagtagtgcagcagcactgaagcactacttcctgcactcactgtgctagctgctcaaaccgtagtagtaacagtccatcaccatcaccatcaccaccaatggctcccaaggttgcgctcttccttgccctaagcctcctgttcgctgccaccgcgcatggctgcgaaccctactgttccggcccagtcgtcccaacaccaccagtcgtgccgactccgtcgtcgcatagccacgggcgctgcccgatcgacgcgctcaagctcaaggtgtgcgccaatgtgctgggcctcgtcaaggtcggcctaccgcaatacgagcaatgctgcccattgctggaggggctggtggaccttgacgccgcattgtgcctctgcaccgccatcaaggcaaacgtcctcggcatccacctcaacgtgccccttagcctcaacctcatcctcaacaactgcggcaagatttgcccagaggacttcacttgccccaactaagcttgagatcccttgtgtgctccatctcgcgattctatttacgagcatgtcggcctcttccaatattagcgaataagtttgtcatttcaaattctctcgctgtaccattgacgattgtatttgtgtggagttatatttgaaattttaatgatcaataagaaatattcgtgttttttattttgagaaaaaaggagatatgacgattgtatttgtgtggagttatatttgaaattttaatgatcaataagaaatattcgtgttttttattttgcc

SEQ ID NO: 289 - DNA, 557 bp, Zea mays
gatcccaaagagcaagagcgcgcactgcagcaccacttcctgcgctgctgctcatcacacaccgtagtactaacactccagcgccacaatggctcccaaggttgcgctcttccttgccctaagcctcctgttcgctgccaccgcgcatggctgcgaaccctactgttccggcccagtcgtcccaacaccaccagtcgtgccgactccgtcgtcgcatagccacgggcgctgcccgatcgacgcgctcaagctcaaggtgtgcgccaatgtgctgggcctcgtcaaggtcggcctaccgcaatacgagcaatgctgcccattgctggaggggctggtggaccttgacgccgcattgtgcctctgcaccgccatcaaggcaaacgtcctcggcatccacctcaacgtgccccttagcctcaacctcatcctcaacaactgcggcaagatttgcccagaggacttcacttgccccaactaagcttgagatcccttgtgtgctccatctcgcgattctatttacgagcatgtcggcctcttccaatattagcgaataagtt

SEQ ID NO: 290 - DNA, 696 bp, Zea mays
acgcggggatcccaaagagcacgcagtgcagcacggaagcaacacttcctgcactcactgctagctgctcacaccatagtagtaacagtccatcactagtcaccaccaatggctcccaaggttgcgctcttccttgccctcagcctcctcttcgctgccgccgcgcatggctgcgaaccctactgtccaggcccagccgtcccaacgccgccagtcctgccgacgccatcgtcgcacagccacgggcgctgcccgatcgacgcgctcaagctcaaggtgtgcgccaacgtgctgggcctcgtcaaggtcggcctaccccagcacgagcaatgttgcccactgctggaggggctggtggacctcgacgccgcactgtgcctctgcaccgccatcaaggccaatgtcctcggcatccacctcaacgtgccccttagtctcaaccttatcctcaacaattgcggcaagatttgcccagaagacttcacttgccccaactaagcttgggatcccttgtgtgctccatctcgcgattctatttacgagcatgtcagcctcttgcaatattagcgaataagtttgtcgtttcaaatgctttcgctgtaccattgacgattgtatttgtgtggagttatatttgaaattttaatgatcaataagaaatattcacgttttctattttgagagaaaggagatatg

SEQ ID NO: 291 - DNA, 706 bp, Zea mays
acgcggggatcccaacgagcacgcagcgcagcactgaggcaccagttcctgcactcactgctagctgctcacaccatagtagtaacagtccatcaccccaggcaccaccaatggctcccaaggttgcgctcttccttgccctcggcctcctcttcgctgccgccgcccatggctgcgaaccctactgtcctggcccagtcgtcccaacgccgacagtcgtgccgacgccatcgtcgcacagtcacgggcgctgcccgatcgacgcgctcaagctcaaggtgtgcgccaacgtgctcggcctcgtcaaggtcggcctgccccaacacgaacaatgctgcccgctgctggaggggttggtggacctcgacgccgcactatgcctctgcaccgccatcaaggccaacgtcctcgacatccacctcaacgtgccccttagcctcaaccttatcctcaacaactgcggcaagatttgcccaaaagacttcacttgccccaactaagcttgggatctcttgtgtgctccatctcgtgattatatttacaagcatgttggcctcttgcaatattagcgaataagttagttgtttcaaattctttcgctgtacctttgacgattgtatttgtgtggagttatatttgagattttaatgatcaataagaaatattcgtgtttttattttgagaaaaaaggagatatgaatcattc

SEQ ID NO: 292 - DNA, 772 bp, Zea mays
gatcccaaagcacaagagaacgcactgcagcaccacttcctgcgctgctgctcatcacacaccgtagtactaacactccatcgccacaatggctcccaaggttgcgctcttccttgccctcagcctcctcttcgctgccgccgcgcatggctgcggaccctattgctccggcccagtcgtaccaaccccaccagtcgtgccgtcgcacagccacgggcgctgcccgatcgacgcgctgaaactcaaggtgtgcgccaacgtgctgggcctcgtcaaggtcggcctgccccaacacgagcaatgctgcccgctgctggagggcctggtggacctcgacgccgcattgtgcctctgcaccgccatcaaggccaacgtcctcggcatccacctcaacgtgccccttagcctcaacctcatcctcaacaattgcggcaagatttgcccaaaggactttacttgccccaactaattgagctgaatatggagataaagccagcatccaaggaatgtaacccttagtgttccatctcgcgattccgattgttacttgatcatcatcactgtttatctatttttatatttaattatcaataagaaacattcacattttttgttttgagaaagatggcaaaatatgtgcaccattactattttagaacaatcctgttctttgtctccctgacgagttttctgggaggtatatataagatagaacgagtgttgatcaattaatccggttgccctcctagtcattcagaatcttccttctccc

SEQ ID NO: 293 - DNA, 803 bp, Zea mays
cattgggaccctcgaggccggccgggccgggatcccaaagcacaagagcacgcactgcagcaccacttcctgcgctgctgctcatcacacaccgtagtactaacactccatcgccacaatggctcccaaggttgcgctcttccttgccctcagcctcctcttcgctgccgccgcgcatggctgcgaaccctactgtcccggcccagtcgtcccaacgccgcccgtcgtgccgtcgcacagccacgggcgctgcccgatcgacgcactgaaagctcaaggtgtgcgccaacgtgctgggcctcgtcaaggtcggcctgccccagcacgagcaatgctgcccgctgctggaggggctggtggacctcgacgccgcactgtgcctctgcaccgccatcaaggccaacgtcctcggcatccacctcaacgtgccccttagcctcaacctcatcctcaacaattgcggcaagatttgcccaaaggactttacttgccccaactaattgagctgaatatggagataaagccagcatccaaggaatgtaccccttagtgttccatctcgcgattccgattgttacttgatcatcatcactgtttatctatttttatatttaattatcaataagaaacattcacattttttgttttgagaaagagggcaaaatatgtgcaccattactattttagaacaatcatgttctctgtctccctgacgagttttccgggaggtatatataagatagaacgagtgttgatcaattaatccggttgccctcctagtcattcagaatcttccttctccc

SEQ ID NO: 294 - DNA, 718 bp, Sorghum bicolor
gcacgaggctctctctctctctctctctctctctctctctctctctctccgcagtgcagcacagcttcctgctcacaccgccgtagtagtaataatccatcaccaatggctcccaaggctgctctcttccttgccctcggcctcctcttggctgcctccgcgcacggctgcgaaccctcttgctcaggccccgtcgtcccgacaccgccggtcgtgccaacgccgccgacccacagccatggtgggcgctgcccgatcgacgcgctcaagctcagcgtgtgcgccaacgtgctgggcctcgtcaaggtcggcttgcccccgcagcaggaatgctgcccgctgctggaggggctggtggacctcgacgccgcattgtgcctctgcactgccatcaaggccaatgtcctcggcatccacctcaacgtgcccgttagcctgagtctcatcctcaataactgcggcaagatttgcccggaggacttcacttgctactaactaattataagctgatgagctgatggacgctccatctcgcgattccggccggttgttacttgatcatcatcggttccaatggccgacatgttgggctgttgcacgatagaataagtttgttacaaattctttttccctgtaccattattattcattgtattgatgatgtggatttatatttccatttttaattatcaataagaatattcatgtttttattttg

SEQ ID NO: 295 - DNA, 896 bp, Sorghum bicolor
caaaataaaaacatgaatattcttattgataattaaaaatggaaatataaatccacatcatcaatacaatgaataataatggtacaggaaaaagaatttgtaacaaacttattctatcgtgcaacagcccaacatgtcggccattggaaccgatgatgatcaagtaacaaccggccggaatcgcgagatggagcgtccatcagctcatcagcttataattagttagtagcaagtgaagtcctccgggcaaatcttgccgcagttattgaggatgagactcaggctaacgggcacgttgaggtggatgccgaggacattggccttgatggcagtgcagaggcacaatgcggcgtcgaggtccaccagcccctccagcagcgggcagcattcctgctgcgggggcaagccgaccttgacgaggcccagcacgttggcgcacacgctgagcttgagcgcgtcgatcgggcagcgcccaccatggctgtgggtcggcggcgttggcacgaccggcggtgtcgggacgacggggcctgagcaagagggttcgcagccgtgcgcggaggcagccaagaggaggccgagggcaaggaagagagcagccttgggagccattggtgatggattattactactacggcggtgtgagcaggaagctgtgctgcactgcgtgctcgtgcctcgtgcgagggggggggagggagggggagcggctcgcgcgctcatcccttgcttcaaaacgaaaggttttagccctccgtttgctggtcgccaaagacgagagcttcgcctttggaagcgccagtagcgtagggcgaccgggccagccgagcctctctgaattagttgacggctttgatgactcgacggtgaatattaaggaaaggagagcctcgtgc

SEQ ID NO: 296 - DNA, 629 bp, Saccharum officinarum
cgaagtgcagcactaaagcaccacttcctgctcgcaccgtagtagtaataatccatcaccaatggctcccaaggttgctctcttccttgccctcggcctcctcctggctgccgccgcgcacggctgcgaaccatattgctccggcccagttgtcccgaccccgccgcctccgtcgcacagccacgggcgctgcccgatcgacgcgctcaagctcagcgtgtgcgccaacgtgctggacctcgtcaaggtcggcttgcccccgcaccaggaatgctgcccgctgctgatggggctggtggacctcgacgccgcattgtgcctctgcactgccatcaaggccaacgtcctcaacatcatcgacctcagtgtgaaccttggcgtgaaactcatcctcaacaactgcggcaagttttgcccggaggacttcacatgccccacttactaattaattaagctgatgagctcaaggatggagctaaagcccgcatccatggaacgtaccccttgtgttcaatctcgcgattcatgattgtacttttgtggagttatattttaaaacttaaattttaaataagtttgttacaaaattctttccctgtaccattaatgattgtatgtttgtggagtta

SEQ ID NO: 297 - DNA, 586 bp, Triticum sp.
  misc_feature (564)..(564): n is a, c, g, or t
  misc_feature (574)..(574): n is a, c, g, or t
caagarmacgcactgcagcaccacttcctgcgctgctgctcatcacacaccgtagtactaacactccagcgccacaatggctcccaaggttgcgctcttccttgccctcagcctcctcttcgctgccgccgcgcatggctgcgaaccctacgttcccggcccagtcgtcccaacgccgcccgtcgtgccgtcgcacagccacgggcgctgcccgatcgacgcactaaagctcaaggtgtgcgccaacgtgctggacctcgtcaaggtcggtctaccccagcacgagcaatgttgcccgctgctggaggggctggtggacctcgacgccgcactgtgcctctgcaccgccatcaaggctaacgtcctcggcatcaactcaacgtgccccttagcctcaacctcatcctcaacaattgcggcaagatttgtccaaaggacttacttgccccaactaattgagctgaatatggagataaagcacatcaaggaatgtacccttartgttcatctgcgattcgatgtactkdtracaccgttacaattaaattaatacataaaaaatcnaatttttttnaaaaaaaaaaaa

SEQ ID NO: 298 - DNA, 2083 bp, Zea mays
gcagcccgtcaggttatatagctcactcttgatcgcttcctggtttgctaagcgatttgcctctcgtggttcggtgacggatcggaggcgctgcgagttcgaagctggtttctctgggctaagtcggttcggacttacttgttcagtaggtgtagtgtagctcgatagacgagaagaatatctggcgtggaagtttcagcaaagctcctggattaaatatttggcatcatagaggaggattcaaatctgccggaaacctgtatcttcatccagtatcaaggggaagttctgttgttgtgtgttcggtgatggatacatccaaaagcaagcaaggaccagaacatctccttgttcttgtccatggtatcatggctagccccaaagactggacatatggggaagcagtgctgaagaggcggttgggtgatgattttttcatatatgctagttcaacgaacagctacaccaaaacctttgatgggattgatgttgctggaagaaggttagcaaatgaagtacgtcctttgaagtttgtcctagaaaaaaggtttcaaacattctccttgttggagactgatatctcctgttcctggatcctaatgaactgcttagaagctctgataattgtgcctatggaaacaggtcttggaagtggttaacaagatgcccagcttgagaaagatttccttcctagcgcattctctgggtggtttgtttgctagatatgttattgcaatactccactcagtctcagtggaaacaaagaatgcaggacaaagtagtgcacttactgttcctacaacaagagggccagcaaaatcaagatgtgcttcaggattaggttctattgctggattgcagccaattaattttattaccttagcaaccccacaccttggggttagagggagaaatcaggtgcatcaccaaaatgtttcggattacgtttgcaaaatatactgcacattatccagcaaaggctcgattcctgggaaaacgaactctctatttgttattttgttcattcatgtagattttgaagttgcatggtatgatttttacaagcttggattatatcattgctgaagtggtcaataccaactagcatctataacttttgaggaaaaaaacgacgaacttattgggacctgttcctgttagtgctgagcaatttctttgacacatgcttatatgtttttcccccgaattaccagcttccgtttcttcaaggcctatcaatcctagaaaagcttgctgcgcctttggctcctttaattgttgggcgcaccggtgctcaactcttcctcactgatggtgatcctagcaagccacctctcctgttacagatggcatccgactgtgatgacaaaaactacatatcagccttggcagcttttaagaaccgtgtcctgtatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgaacgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtcagcatccactgagcggcgaaatatttgggactgggacacacaataagctgtgtatcattatcggccgcctaggttttacattgtttgatgtcaattgtcaaatggcatgtgtttcctcatggaacagacgaagcattcgaagttgatat

SEQ ID NO: 299 - DNA, 1540 bp, Zea mays
ccgggaaaatcccttccccgcggaagcggcagcccgtcaggttatatagctcactcttgatcgcttcctggtttgctaagcgatttgcctctcgtggttcggtgacggatcggaggcgctgcgagttcgaagctggtttctctgggctaagtcggttcggacttacttgttcagtaggtgtagtgtagctcgatagacgagaagaatatctggcgtggaagtttcagcaaagctcctggattaaattggcatcatagagggcgcaggatccaaatctgccggaaacctgtatcttcatccagtatcaaggggaagttctgttgttgtgtgttcggtgatggatacatccaaaagcaagcaaggaccagaacatctccttgttcttgtccatggtatcatggcaagccccaaagactggacatatggggaagcagtgctgaagaggcggttgggtgatgattttttcatatatgctagttcaacgaacagctacaccaaaacctttgatgggattgatgttgctggaagaaggttagcaaatgaagtcttggaagtggttaacaagatgcccagcttgagaaagatttccttcctagcgcattctctgggtggtttgtttgctagatatgctattgcaatactccactcagtctcagtggaaacaaagaatgcaggacagagtagtgcacttactgttcctacaacaagagggccagcaaaatcaagatgtgcttcaggattaggttctattgctggattgcagccaattaattttattaccttagcaaccccacaccttggggttagagggagaaatcagcttccgtttcttcaaggcctatcaatcctagaaaagcttgctgcgcctttggctcctttaattgttgggcgcaccggtgctcaactcttcctcactgatggtgatcctagcaagccacctctcctgttacagatggcatccgactgtgatgacaaaaactacatatcagccttggcagcttttaagaaccgtgtcctgtatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgaacgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtt

SEQ ID NO: 300 - DNA, 2312 bp, Zea mays
tcgaggccggccgggatcccttccgagcggaagcggcagcccgtcaggttagctcgctcttgatcgcttcctggtttgctaagcgatttgcctctcgtggttcggtggcagatcggaggcgctgcgaattcgaagctggtttctctgggctaagtcgattcggacttacttgttcagtaggtgtagtgtagctcgatagacgagaagaatatttggcgtggaagtttcagctaagcaacgagaccaggaagtttcagcaaagctcctggattaaattggcatcatagagggcgcaggatccaaatctgccggaaacctgtatcttcatccagtatcaaggggaagttctgttgttgtgtgttcggtgatggatacatccaaaagcaagcaaggaccagaacatctccttgttcttgtccatggtatcatggcaagccccaaagactggacatatggggaagcagtgctgaagaggcggttgggtgatgattttttcatatatggtaaggcatgctagcatttgaattcttcattcactaggctcattactagtcattatctaaccatttgttctagcttctacagtgccggtttatgacctaaatggatgttaaaaaaagtgtatgcaaacatctttgtctacagctagttcaacgaacagctacaccaaaacctttgatgggattgatgttgctggaagaaggttagcaaatgaagtacgtcctttgaagtttgtcctagaaaaaaggtttcaagcattctccttgttggagactgatatctcctgttcctggatcctaatgaactgctttagaagctctgataattgtgcctatggaaacaggtcttggatgtggttaacaagatgcccagcttgagaaatatttccttcctagcgcattctctgggtggtttgtttgctagatatgctattgcaatactccactcagtctcagtggaaacaaagaatgcaggacagagtagtgcacttactgttcctacaacaagagggccagcaaaatcgagatgtgcttcaggattaggttctattgctggattgcggccaattaattttattaccttagcaaccccacaccttggggttagagggagaaatcaggtgcatcaccaaaatgtttcggattacgtttacaaaatatactgcacattatccagcaaaggctcgattcctgggaaaacgaactctctatttgttattttgttcattcatgtagattttgaagttgcatggtatgatttttacaagcttggattatatcattgctgaagtggtcaataccaactagcatctataacttttgaggaaaaaacgacgaacttattgggacctgttcctgttagtgctgatcaatttctttgacacatgcttatatgtttttcccccgaattaccagcttccgtttcttcaaggtctatcaatcctagaaaagcttgctgcgcctttggctcctttaattgttgggcgcaccggtgctcaactcttcctcactgatggtgatcctagcaagccacctctcctgttacagatggcatccgactgtgatgacaaaaactacatatcagccttggcagcttttaagaaccgtgtcctgtatgccaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgatcgccaaaccgagaaaataccgaggagtaccaccaaatgatggaggaggagatgctccatggcttgcagaaggttggctggaagaaggtggacgtcaacttccattcgtcattctggccttactctgctcacaacaacatacacgtcaagaacgagtggcttcacaatgctggcgctggtgttatcgcgcacgttgcggacagcatcaagcagcaggagtcacggccatgtcttcctgccaatctatagcagtagcattcagcaatccatttgttcaaattatctgtcgctagcaaataaacccatgaccaaactctgttcgtcagcatccactgagcggcgaaatatttgggactgggacacacaataagctgtgtatcattatcggccgcctaggttttacattgtttgatgtcaattgtcaaatggcatgtgtttcctcatggaacagacgaagcattcgaagttgatataaagacaacctaaattgtcaaaaaaaaa

SEQ ID NO: 301 - DNA, 2618 bp, Oryza sativa
gccgcgtcatcctcctcggttgcggcgcggggacgggatggcgtccacgctttcctctccttgccaccaccacctctcctcctattatagccaccaactccgccgcctccgcctccgcctccgcccctccaccgccgcctccggccggccgtcaggttcttcgatcgcccgcctttccatacccattccttctgtatttcattcttgattttggggggaagatgggataaacaattggttatccagtagataacttcgttgatcgattgacgtcgatttttatttttattgctaatggagaagaagctaggtgatattaacttgtttgtttctagcaacatgagggtacaagatctctttcagttttgacacaaccaaatgagcatccaaagtaacactactgtacttagtatcgcgatgttcttcaaaatgctgtgttaatgaaaatgaaatagtgtgctgacagttgattcatgcagaacttgacagtggtagagaactttattcccatccaacgttcgggggaagccgtagccgtgtgtcgcgttcatctttcatggaaaaatcccaaagaaagcgaggaccagatcatctgctgattcttgtccatggtatcattgcaagccccagtgactggacctatggagaagcagtgctaaagaagaggttaggtgacaattttttcatctatgctagttcgtcaaatatctacaccaaaactttcgatgggattgatgttgctggaagaaggttagcaaatgaagtattggatgtgattcagaagatggctggattgagaaagatttccttcctagcacattctttgggtggtttgtttgcgcgatatgctatttctatcctttattcaacagcaatgaaggatgcaagtcaaagtgctgcttgtatagctcctacaactggagggtctgaaaagttggagtgcacttcaggattaggtgcaattgctgggctggaaccaattaattttattaccttagcaaccccacaccttggtgttagagggaaaaatcaggtgggtctctaaatctattaaattatctgatacatttttattcccctcaaaattagttctgctggaagcaaaaactactatattggactttgagttgcctagtaagattttagtataaaactattgttgcatagctaatcggaggccaaagaccagtaaccaagtactacttctgaatatgttgtgacttgtgatcaatgtattaattacatgcattttctgcaataatattaccagcttccatttcttcaagggctatctattctagaaaagattgctgcacctttggctcccttggttgttggccgcactggtgcccaactctttctcacggatggtgaacctagcaagccacctcttctgctagagatggcatctgatcatgaggataaaaaatttatgtaagtcataagaaaggtcttaaggctaacttattatagtagaacatatcttcttcgttcaaacattgtagtagaacatattgtttcttcaatgttcctcagatctgcactagcagctttcaagaaccgcattttgtacgctaatgtttcgtacgaccgtatccttccttactcctagttagtaccacatgatttcctctgcctgatatgcaaacgaatttttttttgctccaaaccattttctattttgctgctcttgttttcttgaacatatgccagatatggtcggatggcgaacatcttcaataagaagagaaaaagaccttacaaaggtgttcagtgatctccactagaatttgattagaaaccaaattgcagcactgtgtgaatacttcagtaatttttttcctcctccatatgcagccctcacatcgttcactggatggctacaagcacattgtgaatatggaatattgttcgcctatatcatctgatggccctcatttccctctgcaagctgccagagccaaagaagctgcacagagtagaccaaacaaagaaaacactgaagaatatcacgaaatgatggaagaggagatgatccatggcttgcagagggtcggttggaagaaagtagatgtcaacttccatacagcactatggccttactttgctcataacaacatacatgttaagaatgagtggcttcacaatgccggtgccggcgtcatcgcccatgtggcggacagcataaaacagcaggagtcacggaaatatttccgtgccaacttataagatcttcagtcccctgtgctgcatggtcagaagtataataactatggtttcctaaataaccaaagcaaaggttttgcctctctagtaggagtgtaggacttgtctcagtagtaagcagtgtcccaaaaaaaaaaactcaacctaaggataatccagattcgttgttctaggaggggtcacatccccttctatgttgagttttttttttttttgggacggatggagtatgttcgatgtgtttagtgtggatatagaaaactagctagttactgtatttttgtccacaaaagcttttttttttctttcgcacagacgtacagttgaaaataaattagtgaaacattattattatttttattatttagttaggttgcattcttgcattattg

SEQ ID NO: 302 - DNA, 1307 bp, Zea mays
agtacaattttgccagcatttatgtgggaagacaactactgtgtctatttctggtcagcacctgtactatcctgtacctgtccgaacgaattctgtgaaattttctcgcggtcaaaccacgtgatctagtggaccaagatttccacgtcaccaagctccggtccaaccgagcagccacatgtatatagtaagtaggtcgtgatagtgatcgtgcagtgaggccgctcggcgcgtcttacagtacgtagcagcagcccggcaccaccagcgtggccggcgccgtcgccgtcccggcggagcgcatgtggaaggtggccttcgccgagaccaagtcggcgctcctgcccaaggcctgcgccggctacgtggacgccgttggggacctcggcgccggcggggagtgagcacaaacataacagtcttacagtacgtagcagcagcctagcacgacgatggtgtccggcagcatcagcgaggagatcgccgtggccgtcccggcggagcgcatgtggaaggtggccttcgccgagaccaagtcggcgctcctgcccaaggcctgcgccggctacgtggacgccgtcgaggtcgacggcgacggcgggcccggcagcgtcaccaccatgaagcttaacccatcgctgggtgagaacaagacgctcaagagccgcgtggtggcgttggacgccgcggcgcgcgtggtgaggacggaggtgctgcagggcggcacggtgagcgcgcagctcaggacgcacttcgccgagatcagggtggaggccgccggcgagggcgcctgcgtcgccaaggtcaaggttgactacgagcgcctcgacggcgcgccgctcgcgcccgaggacgaggccaggctcgcgcaggggtacgtccgcctcgtcaggatggtggaggcatacctcgtcgcgcaccccgacgagttcgcctgagccgccacctttcctacgtacgtgtatgatcatgccatatggccgtgagtgttttggtttggaataacgggaggaaaggctcctctgtttggttgcttcaattcgcttcgaatcgagtatagaccgacgtttgtgagttggtgtatccgtgctgctacaagtgtgtctacatctatggtctatttatctacatgttcttttgtttgtttgcttcgctgtgcaytgtgaggtcgcgtatagacgtattggttgtgttgcaaagaatttgttagatattgagatcgataataatgtatgtatttattcgtttttatgtaattgttgtgttttaaaattttatcgaatatttatatgtagtcscmccacccc

SEQ ID NO: 303 - DNA, 1105 bp, Hordeum vulgare
  misc_feature (1)..(1): n is a, c, g, or t
nattcggcacgaggaggaacacaagacaaggaaatcaataagatggcatcctcctgttccttccttctcctcgctgctcttcttgcgttggtctcatggcaggcaacttcctccgaccctagcccactccaagacttttgtgtggccgacatgcattcaccaggtacagtacggcttcttaccatgctttcaccaaatacatatgctgaaattaatttctaaaaattatatgcatgttcatatcacttcctagtaatacccaagcttacactctacatctcctctattcaccagtgcgtgtaaatgggtttgtttgcaagaaccctatggatgtaaacgctgatgacttcttcaaggcagccgccctcgacaagcctagggtgacaaacaaggttggctccaacgtcaccttgatcaacgtcatgcagattgctggactcaacaccctcggcatctcaattgcgcgcatcgactatgctcccttgggtcagaacccgccacatacgcaccctcgcgccactgagatcctcacggtactcgaggggacactgtatgtcggatttgtcacatccaacctgcctgcacccaacagaaacaagttcctctcaaaggtgctcaacaaaggtgatgtatttgtcatccccgtgggggctcattcactttcagttcaaccccaacccccaccaacccgctattgcaatagccgcgctcatcagccagaacccaaaggctatcacaattgccaatgcaaagttttgggttcataacccacccttatcagatgatgttcttgccaacgcgttttatgtggaaaaaaatactataaactggctccaagctcaattctgggaaaacaaccacaattaaatcacacattgggttgattacacacgagcgcaaaattaaaggccatggttgaaattcctaaaaattgcatctctaaactttataaaattaaaagggacccttatgtaatttgtgtgccctgtaattcaagtgaatgtattttataactcttaaaataatcaaaaaaaatcggtgttttaacaacatccaaatatttatgacaccacatttataacaaatgctacctccccgggggggg

SEQ ID NO: 304 - DNA, 955 bp, Hordeum vulgare
cggcacgaggctcacccaacaaacacaacaggaatacaagagaaaagaagatccgaaggagccgaaaacaaatggcatcctcccctacctaccttctcctcgttgctcttttcgccttggtctcatggcaggctgttgcctccgaccctggcccgctccaggacttttgtgtcgccgacatgcattcaccagtgcgtgtcaatgggtttgtttgcaagaacccaatggatgccaacgctgatgacttcttcaaggcagccgccctcgacaagcctagggtgaccaacaaggttgggtccaacgttaccttgatcaacgtcatgcagattgctggactcaacaccctcggcatctcaattgcacgcatcgactatgctcccttgggtcagaacccaccacacacgcaccctcgtgccactgagatcctcacggtgctcgaggggacactatatgtcggatttgtcacgtccaacctgcccgcccccaacagaaacaagttcctctccaaggtgctcaacaaaggtgatgtgtttgtcttccccgtggggctcattcactttcaattcaaccccaacccccaccagcccgccgttgccattgccgcgctcagcagccagaacccaggggctatcacaattgccaatgctgtttttgggtcagacccaacaatatcagatgatgttcttgccaaggcgtttcaggtggaaaagaatacaatagattggctccaggctcagttctgggagaacaaccaaaactaagtcaggcattgggtgattacccggaagattagtgcataaaccaaggaattagttaagtttctagacatgcatcataagctgtaaaattaatggagcatatgtcaggccggtgtgtgtatgtaaacattgaatgcatttcttccttccaaataattgacaataccattttttttatcacactgaaaaaaaataag

SEQ ID NO: 305 - DNA, 921 bp, Hordeum vulgare
cggcacgaggcaaacaggaacacaaaagaaaagaagagccaaagaaactaaacacaaatgacaacctcctcttccatccttctccttgctgcccttcttgccttggtctcatggcaggccattgcgtccgatcctgacccactccaggacttttgtgtcgccgacatgcattcaccagtgcgtgtcaatgggttcgtttgcaagaacccgatggaagttaatgcagatgacttcttcaaggcagccaacctcgacaagcctagggtgaccaacaaggttggatccaacgtcactttgatcaacgtcatgcagattgctggactcaacaccctcggaatctcaattgcgcgcatcgactatgctcccttgggccaaaacccaccacatacgcaccctcgcgccactgagatcctcacggtgctcgaggggacactgtacgttggctttgtcacatccaaccagcccgcccccaacagaaacaagttcctttccaaggtgctcaacaaaggtgatgtgtttgtctttcccgtggggctcatccacttccaattcaacccgaacccccaccagcctgccgttgcaattgccgcgctcagtagccagaacccaggggctatcacaattgccaatgcagtgtttgggtcagacccaccaatatcggatgatgttctttccaaggcatttcaggttgaaaagaatacaatagactatctccaggctcagttctgggagaacaaccacaattgattgattacacggaatatgagtgcataaaccaaggacttggttgactttctagacatgcatcctaatctataaaataaatggagcatatatcatgtcattgtgtgtttgtaagccctgaatgtatttcagtcctatgaataatcaagaatatgtttttttctcatcaaaaaaaag

SEQ ID NO: 306 - DNA, 1016 bp, Hordeum vulgare
  misc_feature (20)..(21): n is a, c, g, or t
  misc_feature (37)..(38): n is a, c, g, or t
cctcgggtctgcaggcaatnntcggcaccgagggcanncaaacaggaacacaagacaaggaaatcaataagatggcatcctcctgttccttccttctcctcgctgctcttcttgcgttggtctcatggcaggcaacttcctccgaccctagcccactccaagacttttgtgtggccgacatgcattcaccagtgcgtgtaaatgggtttgtttgcaagaaccctatggatgtaaacgctgatgacttcttcaaggcagccgccctcgacaagcctagggtgacaaacaaggttggctccaacgtcaccttgatcaacgtcatgcagattgctggactcaacaccctcggcatctcaattgcgcgcatcgactatgctcccttgggtcagaacccgccacatacgcaccctcgcgccactgagatcctcacggtactcgaggggacactgtatgtcggatttgtcacatccaacctgcctgcacccaacagaaacaagttcctctcgaaggtgctcaacaaaggtgatgtatttgtcttccccgtggggctcattcactttcagttcaaccccaacccccatcagcccgctgttgcaattgccgcgctcagcagccagaacccaggggctatcacaattgccaatgcagtgtttgggtcagacccagcaatatcagatgatgttcttgccaaggcgtttcaggtggaaaagaatactatagactggctccaggctcagttctgggagaacaaccacaattaagtcacacattgggtgattacacggacgacacgtgcgtaaattaagggcatgattgagttcctagatatgcatcctaatttataaaataaaaggagcatatgtaattgtgtgcctgtaatcagtgaatgtatttctaccttttaaataatcaaaaatattgttttttatcacactgatatgatctcacatgcttttttttggttctactgtgtcgtatttctcataattgatcaatattttgggttcaaaaaaaag

SEQ ID NO: 307 - DNA, 1135 bp, Hordeum vulgare
gttctagatcactcacgccacaaccacaaacaggaacacaagacaaggaaatcaataagatggcatcctcctgttccttccttctcctcgctgctcttcttgcgttggtctcatggcaggcaacttcctccgaccctagcccactccaagacttttgtgtggccgacatgcattcaccaggtacagtacggcttcttaccatgctttcaccaaatacatatgctgaaattaatttctaaaaattatatgcatgttcatatcacttcctagtaatacccaagcttacactctacatctcctctattcaccagtgcgtgtaaatgggtttgtttgcaagaaccctatggatgtaaacgctgatgacttcttcaaggcagccgccctcgacaagcctagggtgacaaacaaggttggctccaacgtcaccttgatcaacgtcatgcagattgctggactcaacaccctcggcatctcaattgcgcgcatcgactatgctcccttgggtcagaacccgccacatacgcaccctcgcgccactgagatcctcacggtactcgaggggacactgtatgtcggatttgtcacatccaacctgcctgcacccaacagaaacaagttcctctcgaaggtgctcaacaaaggtgatgtatttgtcttccccgtggggctcattcactttcagttcaaccccaacccccatcagcccgctgttgcaattgccgcgctcagcagccagaacccaggggctatcacaattgccaatgcagtgtttgggtcagacccagcaatatcagatgatgttcttgccaaggcgtttcaggtggaaaagaatactatagactggctccaggctcagttctgggagaacaaccacaattaagtcacacattgggtgattacacggacgacacgtgcgtaaattaagggcatgattgagttcctagatatgcatcctaatttataaaataaaaggagcatatgtaattgtgtgcctgtaatcagtgaatgtatttctaccttttaaataatcaaaaatattgttttttatcacactgatatgatctcacatgcttttttttggttctactgtgtcgtatttctcataattgatcaatattttgggttcaaaaaaaag

SEQ ID NO: 308 - DNA, 1048 bp, Zea mays
  misc_feature (4)..(4): n is a, c, g, or t
  misc_feature (34)..(34): n is a, c, g, or t
cggnaattaccggcctcgacccacgccgtccggnaaaagtttaaaggttccatgtgaacggcacacttcactcacccatccaccgcaaacgccaaacggccggcacacaactacacaagccgctggcaaagatggcctcctccttggtcctcatcgcagcggccctgcttgcgctggcctcgtcgtggcagcaggccatcgcctacgatcctagccccctccaggacttctgtgtcgcagacaagaactcgcctgttcgcgtcaacgggttcccttgcaaggacccgatggcggtcaccccggacgacttcttcaacgcggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaacccgccgcacatccacccacgcgctaccgagctgctcaccgtgctcgagggcaccctctacctcggcttcgtcacgtccaaccccaaccgcctcttctccaaggtggtcaagaagggcgacgtcttcgtcttccccaaggccatgatccacttccagatgaacctcgaccacgacaagcccgccgcggcgctctcgtcgctcagcagccagaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctagtaatatacttgcttgcttatttgttgcatgcatgcaccaccaacacaagccttatattaattacgtacgtacatctatgtataatattgaataaatggccggtatgcatgtggaggagtgaaacttattactgtgcgtgattaataatatttaatgtaaacttttcattattatctaatataaaaaaaagaatacgagttaaaaaaaaacgacagcaacg

SEQ ID NO: 309 - DNA, 1048 bp, Zea mays
tctgtcccccgcgcgtccgctctaccgctccatggccggggtcgacgccggggcggggacgcacacttcactcacccatccaccgcaaacgccaaacggccggcacacaactacacaagccgctggcaaagatggcctcctccttggtcctcatcgcagcggccctgcttgcgctggcctcgtcgtggcagcaggccatcgcctacgatcctagccccctccaggacttctgtgtcgcagacaagaactcgcctgttcgcgtcaacgggttcccttgcaaggacccgatggcggtcaccccggacgacttcttcaacgcggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaacccgccgcacatccacccacgcgctaccgagctgctcaccgtgctcgagggcaccctctacctcggcttcgtcacgtccaaccccaaccgcctcttctccaaggtggtcaagaagggcgacgtcttcgtcttccccaaggccatgatccacttccagatgaacctcgaccacgacaagcccgccgcggcgctctcgtcgctcagcagccagaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctagtaatatacttgcttgcttatttgttgcatgcatgcaccaccaacacaagccttatattaattacgtacgtacatctatgtataatattgaataaatggccggtatgcatgtggaggagtgaaacttattactgtgcgtgattaataatatttaatgtaaacttttcattattatctaatataaaaaaaagaatacgagttaaaaaaaaacgacagcaacg

SEQ ID NO: 310 - DNA, 930 bp, Zea mays
ggaacgcagccagctcgccatagctgattcatatacaatacaagcatcctctccgctgaagagatcaaattccattcagggcagatcgatagaaatggtgtcctccaacttttatcttctcagcgttcttctcatcgccatcgcttctggcgcacgggctacggatcctagtcctctccaagacttctgcgttgcagacaaagaatcgactgtacgtgtgaatgggttgccctgcaaggatattaaggatgtcaaggtggacgacttcttcctagcagccgacctcgacaagccaagggatacgacgacgaacaaggtcaagtcaaatgtcacgttgatcaatgtgatgaagctggccggtctaaacaccttaggcatctccatggccaggattgactatgcccctcaaggacagaacccaccacatactcatccccgtgccactgagatcttaacggttcttgaaggatcactctatgtgggttttgtcacatctaacccagacaacaaattctttagcaagctgctcaacaagggtgatgttttcgtgttcccacaaggcctaatccactttcagttcaatccaagtcatgacaagccagcagttgccctcgccgcactcagcagccagaaccctggtgccattaccatttctaatgcagtatttggatcaaaaccaccaatcgcggatgatgttcttgccaaggcgtttcaggtggacaagaaggttgtagactggctccaagctcagttttgggaggacaaccataactaagtgaagcttgtgcgctattgtcattgttttatgcacctatgtaacaatcaacaacattaatttgatttatttgtattatgtagcaaagtactatgtacttgatgccatatatattctataaaatgttaaatgacctcagttataaatgttaactg

SEQ ID NO: 311 - DNA, 913 bp, Zea mays
ggaacgcagccagctcgccatagctgattcatatacaatacaagcatcctctccgctgaagagatcaaattccattcagggcagatcgatagaaatggtgtcctccaacttttatcttctcagcgttcttctcatcgccatcgcttctggcgcacgggctacggatcctagtcctctccaagacttctgcgttgcagacaaagaatcgactgtacgtgtgaatgggttgccctgcaaggatattaaggatgtcaaggtggacgacttcttcctagcagccgacctcgacaagccaagggatacgacgacgaacaaggtcaagtcaaatgtcacgttgatcaatgtgatgaagctggccggtctaaacaccttaggcatctccatggccaggattgactatgcccctcaaggacagaacccaccacatactcatccccgtgccactgagatcttaacggttcttgaaggatcactctatgtgggttttgtcacatctaacccagacaacaaattctttagcaagctgctcaacaagggtgatgttttcgtgttcccacaaggcctaatccactttcagttcaatccaagtcatgacaagccagcagttgccctcgccgcactcagcagccagaaccctggtgccattaccatttctaatgcagtatttggatcaaaaccaccaatcgcggatgatgttcttgccaaggcgtttcaggtggacaagaaggttgtagactggctccaagctcagttttgggaggacaaccataactaagtgaagcttgtgcgctattgtcattgttttatgcacctatgtaacaatcaacaacattaatttgatttatttgtattatgtagcaaagtactatgtacttgatgccatatatattctataaaatgttaaatgaccccg

SEQ ID NO: 312 - DNA, 944 bp, Zea mays
ggcaccagctcgccatagttgtttcatacacaatacaagcatcctctctactactgaagagatcaaattccattcagggtagatagaaatggcatcctccagcttttatcttctcagcgttcttctcatcgtgatcgcttctggcgcctgggctacggatcctagtcctctccaggacttctgcgttgcagacaaagaatcgcctgtacttgtcaatgggtttgcctgcaaggatgttaaggatgtcaaggtcgacgacttcttcctagcagccgacctcgacaagccaagggatacgacgatgagcaaggtcaagtcaaatgtcacattgatcaatgtgatgaagctggccggcctaaacaccttgggcatctccatggctagaattgactatgcccctcaaggacagaacccaccacatacgcatccccgtgccactgagatcttaactgttcttgaaggatcactctatgttggttttgtcacatctaacccagacaacaaattcattagcaagctactcaacaagggagatgttttcgtgttcccacaaggtctaatccactttcagttcaatccaagtcatgacaagccagcggttgccattgccgcactcaacagccaaaaccctggtgccattaccatttctaacgcagtatttggatcgaaaccaccaatcgcggacgacgttcttgccaaggcatttcaggtggacaagaaggttgtggattggctccaagctcagttttgggaggacaaccataactaagtgaagaggctattgcccttgtttttacacaccgatgtaataagtaacaccactgttttcattcatttgtttgatgtagcaaactactatataccttttgccatacatatattatgttaaaatgtcaaatgaccacagttataaacgtgaaatcttatattgattgattatcttc

SEQ ID NO: 313 - DNA, 790 bp, Zea mays
  misc_feature (749)..(749): n is a, c, g, or t
gatcaacaaccatagacacaaacacaacaagctaataagaagctacgtagctgaatattcagagagcacaaacacaaacgcgagtgcaaaaccaaatggctgcctcgacctacttccttcttgttgcttttctagcattggtcacttctcatgccattgcttctgatcctagcccgctccaagacttctgtgttgccgacaaagactctccggtgaaggtgaatggatttgtttgcaaggaccccatagctgtgaacgctgacgacttcttcaaggctgcaaaactggaccagcctagggacaccaccaagagcaaggtgggatccaacgttactttgatcaatgtcatgcagctgcctggactcaacacgttgggaatctcgttggctcgcattgactacatgcccttaggacagaatcctccacacacacacccacgtgccacggagatcctcaccgtgcttgaagggacactctacgttggatttgtcacctccaaccaagctgacagaagtaacaagctatttgccaaggttctcaacaagggcgatgtgtttgtattcccccaaggactaatccacttccagttcaacccggtccctgacaagccagcagtcgcgctcgctgctctaagtagccagaaccctggagctattactattgccaatgcagtctttggatcaaagccacctatctcaatgatgtactagctaaggcctttcaagtgcaaaggggacattgattggctncagctcagtttggggaaacaccccactgaaaataatcagtt

SEQ ID NO: 314 - DNA, 1012 bp, Zea mays
gaccaacaagctaagaagcgtcattgctgaattcagagagcacaaacaccaaatggctgcctcgacctacctccttctcgttgcttttctagcactgctcacttctcaggccattgcctctgatcctagcccgctccaagacttatgtgttgccgacaaacactctccggtgaatgtgaatggatttgtttgcaaggaccccatgactgtgaacgcagatgacttctttaaggcagcaaaacttgaccaaccaagggacaccaccaagagcaaggtgggatccaacgttactttgatcaatgtcatgcagttgcctggactaaacaccttgggcatctcgttggctcgcatcgactatgcacccttaggtcagaatcctccacacacccacccgcgtgccactgagatcctcaccgtgcttgagggcacactctacgttggatttgtcacctccaaccaagctgacaacaccaacaagctattttccaaggtcctcaacaagggcgatgtttttgtgttcccctaaggactcatccacttccagttcaacccgatccatgacaagccagcagtcgcgatcgctgcactaagtagccagaaccctggagttattactattgcgaatgcagtttttggatcaaagccacctatctcggatgatgtcttggcaaaggctttccaggtgcaaaaggggacaatcgattggcttcaagctcagttttgggagaacaaccactactaaaacaattaagtctgggctcatcatttgagattatagaaatttatttgcattttacatactactccatgtatttattttttcctaggctatgacccataataaaaataaatgttatgtgttcctgtattgtaattgtaattgtgttcctagtgtggctctaccaccatgttcttaatcgaaagtgaatgtaatgtatatgacactctatcgtttcccattttattgggacagatcatatagtaagccatctataaaattgtctacatgccg

SEQ ID NO: 315 - DNA, 975 bp, Zea mays
  misc_feature (963)..(963): n is a, c, g, or t
gatcaacaacatacacacaagcaaacaaaaagctaagaagctccgtagctaaattcaaatattacaaacacaaaagtggagtgcagaaccaaaatggctgcctcgaccgtccttctcgtcgcttttctagcattggtcacttctcatgccattgcctctgatcctagcccgctccaagacttctgtgttgccgacaaagactctccagtgaaggtgaatggatttgtttgcaaggaccctatggctgtgaacgctgacgacttcttcaaggctgcaaaacttgatcagccaagggacaccaccaaaagcaaggtgggatccaacgttactctgattaatgtcatgcaactacctggactcaacacgttggggatctcgttggctcgcattgactacgcaccattaggtcagaatcctccgcacacacacccacgtgccactgagatcctcaccgtgcttgaagggacactctacgtcggatttgtcacctccaaccaagctgacagaagcaacaagctatttgccaaggttctcaacaagggcgatgtgtttgtattcccccaaggactaatccacttccagttcaacccagtacatgacaagccagcagtcgcgctcgctgctctaagtagccagaaccctggagctattactattgccaatgcagtctttggatcaaagccacctatctcggatgatgtcctagctaaggcctttcaggtgcaaaaggggacaattgattggcttcaagctcagttctgggagaacaaccactactgaaaaaatcaagtctgagttcaacatatgagaataaagaaatgtacttgtattttacatactactctatgtgttaacctttttctaggttgcgactgataataaaataaatgttcagtatttatgtactataattgtaattgtgtccctattgtggctccaccacattgtccttaatcgaaaagncaaatgtaaggt

SEQ ID NO: 316 - DNA, 1026 bp, Zea mays
gaccaacaagctaagaagcgtcattgctgaattcagagagcacaaacaccaaatggctgcctcgacctacctccttctcgttgcttttctagcactgctcacttctcaggccattgcctctgatcctagcccgctccaagacttatgtgttgccgacaaacactctccggtgaatgtgaatggatttgtttgcaaggaccccatgactgtgaacgcagatgacttctttaaggcagcaaaacttgaccaaccaagggacaccaccaagagcaaggtgggatccaacgttactttgatcaatgtcatgcagttgcctggactaaacaccttgggcatctcgttggctcgcatcgactatgcacccttaggtcagaatcctccacacacccatccgcgtgccactgagatcctcaccgtgcttgagggcacactctacgttggatttgtcacctccaaccaagctgacaacaccaacaagctattttccaaggtcctcaacaagggcgatgtttttgtgttcccccaaggactcatccacttccagttcaacccgatccatgacaagccagcagtcgcgatcgctgcactaagtagccagaaccctggagttattactattgcgaatgcagtttttggatcaaagccacctatctcggatgatgtcttggcaaaggctttccaggtgcaaaaggggacaatcgattggcttcaagctcagttttgggagaacaaccactactaaaacaattaagtctgggctcatcatttgagattatagaaatttatttgcattttacatactactccatgtatttattttttcctaggctatgacccataataaaaataaatgttatgtgttcctgtattgtaattgtaattgtgttcctagtgtggctctaccaccatgttcttaatcgaaagtgaatgtaatgtatatgacactctatcgtttcccattttattgggacagatcacatagtaagtcatctataaaattgactacaggtcatataacaaggccaa

SEQ ID NO: 317 - DNA, 1047 bp, Zea mays
  misc_feature (89)..(89): n is a, c, g, or t
  misc_feature (104)..(104): n is a, c, g, or t
gctcaaacaccgcaagctaagaagatcccttgctgaattcagagagcacaaacacaaaagcgagtgcaaaaccaaatggcagccttganctacttccttcttgntgcctttctagcgttggtcacatctcaggccattgcctctgaccctagcccgcttcaagacttctgtgttgccgacaaatactctccggtgaaggtaaatggatttgtttgcaaggaccccatggctgtgaacgcagatgacttcttcaaggcagcaaaacttgaccaaccaagggacaccaagaacaaggtgggatccaacgttactttgatcaatgtcatgcagttaccaggactcaacacattgggcatctcgttggctcgcattgactacgcacccttaggtcaaaatcctccacacacccacccacgtgccacagagatcctcaccgtgcttgaggggaaactctatgttggatttgtcacctccaaccaagctaacagcaacaacaagctatttaccaaggtcctcaacaagggtgatgtgtttgtattcccccaaggactcatccacttccagttcaacccggtccatgacaagccagcagtcgcgatcgctgcactaagcagccagaaccctggagttattactattgcgaatgcagtctttggatcaaagccacctatctcggatgatgtcttggcaaaggccttccaggtgcaaaaggggacaatcgattggcttcaagctcaattttgggagaacaaccactactaaaacaattaagtctgggttcatcatttgatattatagaaatttatttgcattttacatactactccatgtatttactttttcctagtctacgacccataataaaaataaatgttctgtgtttctgaactataattgtaattgtgttcctagtgtggctctaccaccatgtccttaatcgaaagtgaatgtaatgtatatggacactctatcgtttcccattttattgggacggatcacatagtaagtcatctataaaattgactacaggtcatataacaaggccaa

SEQ ID NO: 318 - DNA, 1027 bp, Zea mays
gatcaacaaccatagacacaaacacaacaagctaataagaagctacgtagctgaatattcagagagcacaaacacaaacgcgagtgcaaaaccaaatggctgcctcgacctacttccttcttgttgcttttctagcattggtcacttctcatgccattgcttctgatcctagcccgctccaagacttctgtgttgccgacaaagactctccggtgaaggtgaatggatttgtttgcaaggaccccatagctgtgaacgctgacgacttcttcaaggctgcaaaactggaccagcctagggacaccaccaagagcaaggtgggatccaacgttactttgatcaatgtcatgcagctgcctggactcaacacgttgggaatctcgttggctcgcattgactacatgcccttaggacagaatcctccacacacacacccacgtgccacggagatcctcaccgtgcttgaagggacactctacgttggatttgtcacctccaaccaagctgacagaagtaacaagctatttgccaaggttctcaacaagggcgatgtgtttgtattcccccaaggactaatccacttccagttcaacccggcccatgacaagccagcagtcgcgctcgctgctctaagtagccagaaccctggagctattactattgccaatgcagtctttggatcaaagccacctatctcggatgatgtcctagctaaggcctttcaggtgcaaaagggtacaattgattggcttcaagctcagttttgggagaacaaccactattgaaaaaaataaatcaagttacagttcattgtatgggaatataatgatttatttacattttacatactactctatgtatttattttttctagactttcagctgataataaaataaatggattgtatttatgaactataattgtaatgtgtcccaattgtggttctaccaccatgtccttaatcgaaagtgcatgtaatgtatatggcactctctcgtttcccattttattgagagtgttcactac

SEQ ID NO: 319 - DNA, 1068 bp, Zea mays
actcctactcgaggccggccgggagaagaccggccgggatcaaaaagatagacacactcaaacaccgcaagctaagaagatcccttgctgaattcagagagcacaaacacaaaagcgagtgcaaaaccaaatggcagccttgacctacttccttcttgttgcctttctagcgttggtcacatctcaggccattgcctctgaccctagcccgctccaagacttctgtgttgccgacaaatactctccggtgaaggtaaatggatttgtttgcaaggaccccatggctgtgaacgcagatgacttcttcaaggcagcaaaacttgaccaaccaagggacaccaagaacaaggtgggatccaacgttactttgatcaatgtcatgcagttaccaggactcaacacattgggcatctcgttggctcgcattgactacgcacccttaggtcaaaatcctccacacacccacccacgtgccacagagatcctcaccgtgcttgaggggaaactctatgttggatttgtcacctccaaccaagctaacagcaacaacaagctatttaccaaggtcctcaacaagggtgatgtgtttgtattcccccaaggactcatccacttccagttcaacccggtccatgacaagccagcagtcgcgatcgctgcactaagcagccagaaccctggagttattactattgcgaatgcagtctttggatcaaagccacctatctcggatgatgtcttggcaaaggccttccaggtgcaaaaggggacaatcgattggcttcaagctcaattttgggagaacaaccactactaaaacaattaagtctgggttcatcatttgatattatagaaatttatttgcattttacatactactccatgtatttactttttcctagtctacgacccataataaaaataaatgttctgtgtttctgaactataaaaaaaaaaaaaaaactagtgtggctctaccaccatgttcttaatcgaaagtgaatgtaatgtatatgacactctatcgtttcccattttattgggacagattcatatagtaagccatcc

SEQ ID NO: 320 - DNA, 1101 bp, Zea mays
actcctactcgaggccggccgggagaagaccggccgggatcaaaaagatagacacacwcaaacaccgcaagctaagaagatcccttgctgaattcagagagcacaaacacaaaagcgagtgcaaaaccaaatggctgcctcgacctacttccttcttgttgcttttctagcattggtcacttctcaggccattgcctctgatcctagcccgctccaagacttctgtgttgccgacaaatactctccggtgaaggtaaatggatttgtttgcaaggaccccatggctgtgaacgcagatgacttcttcaaggcagcaaaacttgaccaaccaagggacaccaagagcaaggtgggatccaacgttactttgatcaatgtcatgcagttgcctggactcaacaccttgggcatctcgttggctcgcattgactaygcacccttaggtcagaatcctccacacacccacccacgtgccactgagatcctcaccgtgcttgagggcacactctacgttggatttgtcacctccaaccaagctgacaacaccaacaagctattttccaaggtcctcaacaagggcgatgtttttgtgttcccccaaggactcatccacttccagttcaacccgatccatgacaagccagcagtcgcgatcgctgcactaagtagccagaaccctggagttattactattgcgaatgcagtttttggatcaaagccacctatctcggatgatgtcttggcaaaggctttccaggtgcaaaaggggacaatcgattggcttcaagctcagttttgggagaacaaccactactaaaacaattaagtctgggctcatcatttgagattatagaaatttatttgcattttacatactactccatgtatttattttttcctaggctatgacccataataaaaataaatgttatgtgtttctgaactataattgtaattgtgttcctagtgtggctctaccaccatgtycttaatcgaaagtgaatgtaatgtatatgacactctatcgtttcccattttattgggacagatcatatagtaagccatctataaaattgwctacaggtcatataacaaggccaa

SEQ ID NO: 321 - DNA, 973 bp, Zea mays
  misc_feature (863)..(863): n is a, c, g, or t
  misc_feature (875)..(875): n is a, c, g, or t
  misc_feature (940)..(940): n is a, c, g, or t
cattgggtacctcgaggccggccgggacaacatcaacaaagcaaacatactgtacacagtagtgccaacattaaatggctgcgtcctcgtacttccttcttgctgcttttctagctgtaacagcttctcatgccaccgcttccgatcctagcccgctccaggatttctgtgttgctgatattcactctcctgtgaaggtgaatggatttgtttgtaaggatcctatggcggtgaccccagatgacttcttcaaagcagccaatcttgataaagctagagacaccatgaagagtaaggtggggtccaatgtcactttgatcaacgtcatccagctccctggcctcaacactcttggcatctccctggcacgtatcgactacgcgccattgggcgagaacccgccgcacacccacccacgtgccacggagatcctcacggttctcgaggggacactgtacgtcgggtttgtcacctccaacccaaacaagctatttgccaaggtgctcaacaagggcgatgtgttcgtgttcccccaaggtctcatccattttcaattcaacccggtctatgacaagccggccgttgctatcgcggctctcagcagccagaaccctggggttattaccatcgccaatgcggtctttggatcaaagccaccgatttcggatgatgtcttggccaaggcttttcaggtggagaaggggacgattgattggctccaggctcaattctgggagaacaaccactactaaataaatcacatatcgcttatcgtataaaagaatgctttttacatatgcactttgagtaataatacaactacatgtttttaggtttcatagtaaaataggccctaaaaattnaaaaaagtaganggttccagtggttttggggtgctattttgtatcgcatggttcttgggtgcaatgacctctatggnagttctaaataataatctttcgcttgaaaaaaa

SEQ ID NO: 322 - DNA, 981 bp, Zea mays
cattgggtacctcgaggccggccgggacaacatcaacaaagcaaacatactgtacacagtagtgccaacattaaatggctgcgtcctcgtacttccttcttgctgcttttctagctgtaacagcttctcatgccaccgcttccgatcctagcccgctccaggatttctgtgttgctgatattcactctcctgtgaaggtgaatggatttgtttgtaaggatcctatggcggtgaccccagatgacttcttcaaagcagccaatcttgataaagctagagacaccatgaagagtaaggtggggtccaatgtcactttgatcaacgtcatccagctccctggcctcaacactcttggcatctccctggcacgtatcgactacgcgccattgggcgagaacccgccgcacacccacccacgtgccacggagatcctcacggttctygaggggacactstacgtcgggtttgtcacctccaacccaaacaagctatttgccaaggtgctcaacaagggygatgtgttcgtrttcccccaaggtctcatccatttycaattcaacccggtctatracaagccggccgttgctatcgcggcgctcagcagccagaaccctggggttattaccatcgccaatgcggtcttcggatcaaagccaccgatttcggatgatgtcttggcaaaggctttccaggtggagaaggggacaattgattggctccaggctcaattctgggagaacaaccactactaaataaatcacatatagcttatcgtatcaaagaatgctttttacatatgcactttgagtaataatacaactacatgtttttaggtttcatagtaaaataggccctaaaattaaaaaagtagaggttccagtgttttgggtgctattttgtatcgcatgcttcttggtgcaatgacctctatggaagttcgaaataataatctttgttcttgtcgttgggttagatttcact

SEQ ID NO: 323 - DNA, 1022 bp, Oryza sativa
ccttggacctgactggactgaaggagtagaaaatcttactcaaagtctcaaacgataaccacagggagaggagctagtaaaaatagctagctaactaccagagagagatacaatggcctcctcttccttatttctcctgggtgctcttcttgtgctggcctcatggcaggccatcgtcgcctatgatcctagcccgctccaagatttctgcgttgcagacatgaactcacctgtgcgagtgaatggatttgcttgcaagaatccaatggatgtgagctcggaagacttcttcaatgcagccaagtttgatatgccaaggaatacttttaacaagctcgggtccaacgtcaccaacctcaacgtcatggagtttccgggtctcaatacccttggcatctcactagctcgtatcgactacgcgccaatgggtgtgaacccaccacacatacatccccgtgctactgagctccttaccgtgcttgagggaacactctatgttggttttgtcacgtccaacccaaacaagctcttctctaaggtggtttgtaagggtgacgtgtttgtgttccctaaggcaatgattcacttccaaatgaacctagatcatgacaagccagcagttgcccaatcagcactcagtagccaaaaccctggagttattactattgcaagcgcggtgtttggctcacagccaccgatctccgatgatgttctgaccaaggcgtttcaggtggaaaagaagctaattgattggctccaatctcagttctgggagaacaactactgattatattcttatatatttattgtgcttttgtgtatgggagggtgatatgcaccttgcacttttcataaagtatgttacagtatgtaaaataaacgggcttttgctggccaattagtgtgtcacgatatgttgctacagtcgtttgattatccgtgtttaataactggaatgaaatggacattgttacatcctctttttcctcgttaatataaaagctaatggtcgttcatgaagt

SEQ ID NO: 324 - DNA, 1001 bp, Oryza sativa
caaagaatcttactcaaagtctcaaacgataaccacagggagaggagctagtaaaaatagctagctaactaccagagagagatacaatggcctcctcttccttatttctcctgggtgctcttcttgtgctggcctcatggcaggccatcgtcgcctatgatcctagcccgctccaagatttctgcgttgcagacatgaactcacctgtgcgagtgaatggatttgcttgcaagaatccaatggatgtgagctcggaagacttcttcaatgcagccaagtttgatatgccaaggaatacttttaacaagctcgggtccaacgtcaccaacctcaacgtcatggagtttccgggtctcaatacccttggcatctcactagctcgtatcgactacgcgccaatgggtgtgaacccaccacacatacatccccgtgctactgagctccttaccgtgcttgagggaacactctatgttggttttgtcacgtccaacccaaacaagctcttctctaaggtggtttgtaagggtgacgtgtttgtgttccctaaggcaatgattcacttccaaatgaacctagatcatgacaagccagcagttgcccaatcagcactcagtagccaaaaccctggagttattactattgcaagcgcggtgtttggctcacagccaccgatctccgatgatgttctgaccaaggcgtttcaggtggaaaagaagctaattgattggctccaatctcagttctgggagaacaactactgattatattcttatatatttattgtgcttttgtgtatgggagggtgatatgcaccttgcacttttcataaagtatgttacagtatgtaaaataaacgggcttttgctggccaattagtgtgtcacgatatgttgctacagtcgtttgattatccgtgtttaataactggaatgaaatggacattgttacatcctctttttcctcgttaatataaaagctaatggtcgttcatgaagtacatg

SEQ ID NO: 325 - DNA, 951 bp, Oryza sativa
ctgactggactgaaggagtagaaaatctctcacccaaaataacgataaacacagggagagagagagagaaagaaattcaatggcctcctcttccttatttctgctagcttctcttcttgttctggcctcatggcagcaggccatcgcctttgatcctagcccgctccaagatttctgcgtcgccgacatggcctcacctgtgcgagtaaatgggtttccttgcaagaacccaatgaatgtcacatcggacgacttcttcaacgcggccaagtttgacatgccaaggaatactatgaataaagtcgggtctaatgtcaccaacctcaacgtcatcaatttcccgggcctcaacactcttggcatctcactagctcgcatcgactacgcgccaatgggtgtcaacccaccacatgtgcatcctcgtgctactgagcttctcactgtgcttgagggaacactttatgttggttttgttacatccaaccctaacaggctcttctccaaggtggtgcataagggtgatgtgttcgtgttccctaaggcaatgattcactttcaaatgaacctagaccacaataagcctgcggttgcccaatcagcactcagcagtcaaaacccaggagttattactattgctagtgccatatttggatcaacgccaccaatctctgatgatgttttagtcaaggcatttcaagtggagaagaaggtgattgattggctgaagtctcaattctcggagaataaccactactgattatatcatgtttcttgattgttcctttgtgcgttataatatgtataataaatgggcttttgcctagttgatgtcatggtatgctaaaacagtatgtttgatcgtccatgtttaataaatgtaatgcaatatggacacagtacggcgtccttttcctaattatatattaatataaaagaatgattgttcatgga

SEQ ID NO: 326 - DNA, 927 bp, Oryza sativa
ctctcacccaaaataacgataaacacagggagagagagagagaaagaaattcaatggcctcctcttccttatttctgctagcttctcttcttgttctggcctcatggcagcaggccatcgcctttgatcctagcccgctccaagatttctgcgtcgccgacatggcctcacctgtgcgagtaaatgggtttccttgcaagaacccaatgaatgtcacatcggacgacttcttcaacgcggccaagtttgacatgccaaggaatactatgaataaagtcgggtctaatgtcaccaacctcaacgtcatcaatttcccgggcctcaacactcttggcatctcactagctcgcatcgactacgcgccaatgggtgtcaacccaccacatgtgcatcctcgtgctactgagcttctcactgtgcttgagggaacactttatgttggttttgttacatccaaccctaacaggctcttctccaaggtggtgcataagggtgatgtgttcgtgttccctaaggcaatgattcactttcaaatgaacctagaccacaataagcctgcggttgcccaatcagcactcagcagtcaaaacccaggagttattactattgctagtgccatatttggatcaacgccaccaatctctgatgatgttttagtcaaggcatttcaagtggagaagaaggtgattgattggctgaagtctcaattctcggagaataaccactactgattatatcatgtttcttgattgttcctttgtgcgttataatatgtataataaatgggcttttgcctagttgatgtcatggtatgctaaaacagtatgtttgatcgtccatgtttaataaatgtaatgcaatatggacacagtacggcgtccttttcctaattatatattaatataaaagaatgattgttcatgaaag

SEQ ID NO: 327 - DNA, 982 bp, Oryza sativa
aaataggtgtcaagtggaagtgcagtgatgtatcacagaaaccataaacacacaggcatctgattagagaaatctaatggcttcttcttccttttccttcctgcttgttgctgctcttcttgggttggcctcatggaaagccattgcctcagaccctagccctctccaagacttttgtgtcgctgatctgaattcgccagtgcgagtaaatggatttgtttgcaagaacccaatgaacgcgagtgccgacgacttcttcaaggcagccatgctcgataagcctagagacacaaacaataaggttgggtccaatgtcactttggtcaatgtcttgcagcttcctggtctcaatacccttggcatctcgatagcacgtcttgactttgcacccttgggtttgaacccaccacacacgcaccctcgtgcaaccgagatcttcacggtgcttgaaggaacactctacgttggctttgttacgtccaacccagataacaggctattgtccaaggtgctcaacaagggtgatgtgtttgtgttccctgaggggctcatccacttccagttcaatcctaacccacacaagccggcagttgccattgctgcactgagtagccaaaatcccggggttattactattgccaatgcggtgtttggatcgaacccacctatctcagatgatattttgatgaaggcgtttcaggtggataagaagatcatagatttgctccaagctcagttctagaagaacaactactgattgtcctgttggttgcaccattaaggacagtatactacatgcacctgatgctatgtaactatcatatatgatacgtagaataagtggggttttatgtgctgaaattgttatcatgcatgatatgctaaagcagtatgttattggacatggaatatgttggactgtggcgttcttttccctcgtaattaaaatgaaaagcaaacctcttgaagtccgaaaaaaaaa

SEQ ID NO: 328 - DNA, 1042 bp, Oryza sativa
aaataggtgtcaagtggaagtgcagtgatgaatcacagaaaccataaacacacaggcatctgattagagaaatctaatggcttcttcttccttttccttcctgcttgttgctgctcttcttgggttggcctcatggaaagccattgcctcagaccctagccctctccaagacttttgtgtcgctgatctgaattcgccagtgcgagtaaatggatttgtttgcaagaacccaatgaacgcgagtgccgacgacttcttcaaggcagccatgctcgataagcctagagacacaaacaataaggttgggtccaatgtcactttggtcaatgtcttgcagcttcctggtctcaatacccttggcatctcgatagcacgtcttgactttgcacccttgggtttgaacccaccacacacgcaccctcgtgcaaccgagatcttcacggtgcttgaaggaacactctacgttggctttgttacgtccaacccagataacaggctattgtccaaggtgctcaacaagggtgatgtgtttgtgttccctgaggggctcatccacttccagttcaatcctaacccacacaagccggcagttgccattgctgcactgagtagccaaaatcccggggttattactattgccaatgcggtgtttggatcgaacccacctatctcagatgatattttgatgaaggcgtttcaggtggataagaagatcatagatttgctccaagctcagttctagaagaacaactactgattgtcctgttggttgcaccatcaaggacagtatactacatgcacctgatgctatgtaactatcatatatgatacgtagaataagtggggttttatgtgctgaaattgttatcatgcatgatatgctaaagcagtatgttattggacatggaatatgttggactgtggcgttcttttccctcgtaattaaaatgaaaagcaaacctcttgaagtccatgaaaaaaaaattatatatgcatgttactatggactcggaaagacgttatatgtttctatgcctaaaag

SEQ ID NO: 329 - DNA, 952 bp, Oryza sativa
atcaactatagctatacaagaatcatcgaccactacttgtacacaagcaaaagttccatcaacttaacatggcctcctccaacttctttcttcccacagctctcatcgctttggtcgctactcaggccatggcttttgatcccagtcctcttcaggacttctgcgttgccgacaggaactctccagtacgtgtcaatgggttcccctgcaaggatgctaaggatgtgaatgttgatgacttcttcctagaagctaacctcgacaagccgatggacacaaccaagagcaaggctggatccaatgttacattgatcaacgtgatgaaactcacaggtctcaacacccttggcatctccatggcaaggatcgactatgctcctaaagggcaaaacccaccacacacgcatccccgtgctaccgagatcctaacggtttttgagggtacactctatgttggttttgttacatcgaaccaagcaaacggagaaaacaagctattcaccaagacacttaacaagggtgatgtcttcgtgttcccacaaggtctcattcacttccagttcaatccaagctatgataagccagcagttgccatcgctgcacttagcagccagaatcctggagcgattaccattgctaatgcagtatttggatcaaatccaccaatctcggatgatgttcttgctaaggcatttcaagtggataagaaggccgtggattggctccaagctcaattctgggagaacaaccacaactaaattattgatgcttgataaggctcaaaattagtgattgctagtaaaaatgttttgttgattgttgttagctaaatattgtatactgtataacactacgcatcaataatgtataacactacgcacatatatatgttacaagatgtatgatctatggaattactttaatatatttgatttcttggtactttttacac

SEQ ID NO: 330 - DNA, 948 bp, Oryza sativa
atcaactatagctatacaagaatcatcgaccactacttgtacacaagcaaaagttccatcaacttaacatggcctcctccaacttctttcttcccacagctctcatcgctttggtcgctactcaggccatggcttttgatcccagtcctcttcaggacttctgcgttgccgacaggaactctccagtacgtgtcaatgggttcccctgcaaggatgctaaggatgtgaatgttgatgacttcttcctagaagctaacctcgacaagccgatggacacaaccaagagcaaggctggatccaatgttacattgatcaacgtgatgaaactcacaggtctcaacacccttggcatctccatggcaaggatcgactatgctcctaaagggcaaaacccaccacacacgcatccccgtgctaccgagatcctaacggtttttgagggtacactctatgttggttttgttacatcgaaccaagcaaacggagaaaacaagctattcaccaagacacttaacaagggtgatgtcttcgtgttcccacaaggtctcattcacttccagttcaatccaagctatgataagccagcagttgccatcgctgcacttagcagccagaatcctggagcgattaccattgctaatgcagtatttggatcaaatccaccaatctcggatgatgttcttgctaaggcatttcaagtggataagaaggccgtggattggctccaagctcaattctgggagaacaaccacaactaaattattgatgcttgataaggctcaaaattagtgattgctagtaaaaatgttttgttgattgttgttagctaaatattgtatactgtataacactacgcatcaataatgtataacactacgcacatatatatgttacaagatgtatgatctatggaattactttaatatatttgatttcttggtacttttt

SEQ ID NO: 331 - DNA, 910 bp, Oryza sativa
catagactacagctatacaagaagcatcgaccactacttgtacacaagcaaaagttccatcaacttaacatggcctcctcgaacttctttcttctcacagctctcatcgctttggtcgctactcaggccatggcttctgatcccagtcctcttcaggacttctgcgttgccgacaggaactctccagtacatgtcaatgggttcccttgcaaggatgctaaagatgtgaatgttgatgacttcttcctagcagctaacctcgacaagccgatggacacaaccaagagcaaggctggatccaatgttacattgatcaatgtgatgaaactcgcaggtctcaacacccttggcatctccatggcaaggatcgactatgctcctaaagggcaaaacccaccacacacgcatccccgtgctaccgagatcctaactgttcttgagggtacactctatgttggttttgttacatcgaaccaagcaaacggagaaaacaagctcttcaccaagacacttaacaagggtgatgtcttcgtgttcccacaaggtctcattcacttccagttcaatccaagctatgataagccagcagttgccatcgctgcacttagcagccagaaccctggagcgattaccattgctaatgcagtatttggatcaaattcaccaatctcggatgacgttcttgctaaggcatttcaggtggacaagaaagctgtggattggctccaagctcagttctgggagaacaaccataactaaattattgatgcttgataaggttcaaaactagtgattggtagtaaaaagagtttgttgattattatattagctaaatattgtatacttcatgtaatcctaaactcgatattttatatgattctttttatgaataatgtatatcagtacacat

SEQ ID NO: 332 - DNA, 988 bp, Oryza sativa
aaagcatcacccaacgataaacacaacctgttagctagctagcttctcagccaccagagaaacagcaaataattcagtagagaagagaacagaaaaccaaagccaaatggcttcaccatcttccttctgcctcctcgctgttcttcttgcgttggtctcgtggcaggccatcgcttctgatcctagccctctgcaggacttctgcgttgccgataagcactcacctgtgcttgttaatggatttgcttgcctggacccaaagtacgtgaatgcagaccacttcttcaaggcagccatgctcgacactcctagaaaaacaaacaaggttggatcaaatgtcacactgatcaacgtcatgcagatccctggacttaatacactcggcatctcaattgcacgcatcgactacgcacccttgggtgagaacccaccgcacacacacccccgtgcaactgagatcctcacagtccttgagggaaccctctatgtcggctttgtcacatctaatccaaacaacacactattctccaaggtgctcaacaagggtgatgtgtttgttttccctgaggggctcatccacttccaattcaaccctaacccccatcagcctgcggttgcacttgctgcacttagcagccaaaaccctggggctattaccattgcaaatgcagtgttcggatcaaagccaccgatctcagatgatattttggcaaaggcattccaggttgagaagggcaccattgattggctccaggctcagttttgggagaacaaccactactaaatctaaacaaagtatatgtgttgttatactatgtataagtttctattctgcaatatataaaataaatttgtatttctagtcggcttaattatgtgtgcttgcaagcacatcaacaatacattattttgttgggaaaaggctttgtatgttgttctagtgtggtatcccctgttataaaggtaataaaggaaaacattggtatta

SEQ ID NO: 333 - DNA, 983 bp, Oryza sativa
atcacccaacgataaacacaacctgttagctagctagcttctcagccaccagagaaacagcaaataattcagtagagaagagaacagaaaaccaaagccaaatggcttcaccatcttccttctgcctcctcgctgttcttcttgcgttggtctcgtggcaggccatcgcttctgatcctagccctctgcaggacttctgcgttgccgataagcactcacctgtgcttgttaatggatttgcttgcctggacccaaagtacgtgaatgcagaccacttcttcaaggcagccatgctcgacactcctagaaaaacaaacaaggttggatcaaatgtcacactgatcaacgtcatgcagatccctggacttaatacactcggcatctcaattgcacgcatcgactacgcacccttgggtgagaacccaccgcacacacacccccgtgcaactgagatcctcacagtccttgagggaaccctctatgtcggctttgtcacatctaatccaaacaacacactattctccaaggtgctcaacaagggtgatgtgtttgttttccctgaggggctcatccacttccaattcaaccctaacccccatcagcctgcggttgcacttgctgcacttagcagccaaaaccctggggctattaccattgcaaatgcagtgttcggatcaaagccaccgatctcagatgatattttggcaaaggcattccaggttgagaagggcaccattgattggctccaggctcagttttgggagaacaaccactactaaatctaaacaaagtatatgtgttgttatactatgtataagtttctattctgcaatatataaaataaatttgtatttctagtcggcttaattatgtgtgcttgcaagcacatcaacaatacattattttgttgggaaaaggctttgtatgttgttctagtgtggtatcccctgttataaaggtaataaaggaaaacattggtatta

SEQ ID NO: 334 - DNA, 851 bp, Oryza sativa
catcacccaacaaagcagtaactaattctagctagctcagctagagaaacagcaaataattcagcaagaggaagagcagaaattaatccaaagccgaatggcctcaccctcttccttgtgtctcctcgctgctctcgcgttgatctcatggcaggccatggcctctgatcctagtcctctgcaggacttctgcgttgccgatatgcactcacctgtgcgtgtcaatggatttgcttgcttgaacccaatggaagtgaatgcagaccattttttcaaggcagccaagcttgacacccctagaaaaacaaacaaggttgggtccaacgtcaccctaatcaacgtcatgcagattcctggtctcaacacactcggcatctcaattgcgcgcattgactatgcacccttgggacagaacccaccgcacacacatccccgtgccactgagatcctcacggtgcttgagggaacattatatgtcggcttcgtcacatctaacccaaacaacacgttattttccaaggtactcaacaagggtgatgtgttcgtgttccctcaggggctcatccacttccaattcaaccctaacccacatcagcctgctgttgcaattgctgcacttagcagccaaaaccccggtgccattaccattgcaaatgcagtgtttggatcaaagccaccaatctcggatgaagttttagcgaaggcatttcaagttgagaagggtactatagactggctccaggctcagttctgggagaacaaccactactaattaaatttgaatatttatttgtatacaatgtattagcttttgtgttacaatatataaaataaatttgtatttctggacc

SEQ ID NO: 335 - DNA, 938 bp, Oryza sativa
aagcagttagccagccacaagctaagagaaacagcaaataattcagtagagaagatagcagaaacccaaagccaaaaatggcttcaccgtccttctgcctcttcgctgctcttcttgctttggtctcatggcaggccatcgcttctgaccctagccctctgcaggacttctgcgttgccgataagcactcgcctgtgcttgtcaatggatttgcttgcttggacccaaagtatgtgacagcagaccacttcttcaaggcagccatgcttgacactcctaggaagacaaacaaggttggatccaacgtcacattgatcaacgtcatgcagatccctggactcaatacgctcggcatctcaattgctcgcattgactatgcgcctttgggtcagaacccaccgcatacgcaccctcgtgccactgagatcctcacagtgcttgagggaacacttcacgtcggcttcgtcacatctaacccaaacaacacactattctccaaggtacttaacaagggtgatgtctttgtgttccccgtgggactcatccactttcaattcaaccctaacccccaccaacccgcagttgcaattgctgctcttagcagtcaaaaccctggtgtcatcactattgcaaatgcagtttttggatcgaagccaccaatctcagatgaagttttggcaaaggcattccaagttggaaagggaaccatagattggctccaggctcagttctgggagaacaaccactactaattatcctaaaaaattatcggcttacggactatgtttttattttatatacaacataaataagtggtatggagtttgtacttgttatgcatacttgcaagctgtgagtttttttttctaatgtactaataccaatatacatgtatggttttcccatttaataaatggaatacagtatggtgttcgtta

SEQ ID NO: 336 - DNA, 675 bp, Oryza sativa
atggcctcaccctcttccttgtgtctcctcgctgctctcgcgttgatctcatggcaggccatggcctctgatcctagtcctctgcaggacttctgcgttgccgatatgcactcacctgtgcgtgtcaatggatttgcttgcttgaacccaatggaagtgaatgcagaccattttttcaaggcagccaagcttgacacccctagaaaaacaaacaaggttgggtccaacgtcaccctaatcaacgtcatgcagattcctggtctcaacacactcggcatctcaattgcgcgcattgactatgcacccttgggacagaacccaccgcacacacatccccgtgccactgagatcctcacggtgcttgagggaacattatatgtcggcttcgtcacatctaacccaaacaacacgttattttccaaggtactcaacaagggtgatgtgttcgtgttccctcaggggctcatccacttccaattcaaccctaacccacatcagcctgctgttgcaattgctgcacttagcagccaaaaccccggtgccattaccattgcaaatgcagtgtttggatcaaagccaccaatctcggatgaagttttagcgaaggcatttcaagttgagaagggtactatagactggctccaggctcagttctgggagaacaaccactactaa

SEQ ID NO: 337 - DNA, 762 bp, Oryza sativa
ttaatcggcacgagggttagccagccacaagctaagagaaacagcaaataattcagtagagaagatagcagaaacccaaagccaaaaatggcttcaccgtccttctgcctcttcgctgctcttcttgctttggtctcatggcaggccatcgcttctgaccctagccctctgcaggacttctgcgttgccgataagcactcgcctgtgcttgtcaatggatttgcttgcttggacccaaagtatgtgacagcagaccacttcttcaaggcagccatgcttgacactcctaggaagacaaacaaggttggatccaacgtcacattgatcaacgtcatgcagatccctggactcaatacgctcggcatctcaattgctcgcattgactatgcgcctttgggtcagaacccaccgcatacgcaccctcgtgccactgagatcctcacagtgcttgagggaacacttcacgtcggcttcgtcacatctaacccaaacaacacactattctccaaggtacttaacaagggtgatgtctttgtgttccccgtgggactcatccactttcaattcaaccctaacccccaccaacccgcagttgcaattgctgctcttagcagtcaaaaccctggtgtcatcactattgcaaatgcagtttttggatcgaagccaccaatctcagatgaagttttggcaaaggcattccaagttggaaagggaaccatagattggctccaggctcagttctgggagaacaaccactactaa

SEQ ID NO: 338 - DNA, 951 bp, Oryza sativa
catctcaaacacaccacctgaattaacaagcaggtatatataagctactagctaattaagaagggcattagaatggcttcgtcttccttcctgctcctcgccactcttcttgccatggcctcatggcaaggcatggcttcggatcccagccctctgcaggacttctgcgttgccgacatgcactcacctgtgcttgtcaatggatttgcttgcctgaacccaaaggacgtgaacgcggatcacttcttcaaggcagcaatgttggacactcctcggaagacgaacaaagttgggtctaacgtcacactgatcaacgtcatgcagatccctggcctcaacacactcggcatctcaattgcacgtattgactatgcaccgttaggtcaaaaccctccccacactcatcctcgtgccaccgaaatcctcacggtgcttgaaggaacactctatgtcggcttcgtcacgtctaacccagataacaagtttttctccaaagtgctcaataagggtgatgtgttcgtattccctgtggggctcatccacttccaatttaaccctaacccctacaagcccgcggtcgcaattgccgcacttagcagccagaaccctggtgccatcaccattgcaaatgcggtgtttgggtcgaagccaccaatctccgatgatgttttggccaaggcattccaggtcgaaaaggggacaatagattggctccaagcccagttctgggagaacaaccattactgatcatcttactgattgcatttaagaaaaagttatgtgcagttacagagatcctgcataattaactttatatactacaataaaatgacttctatttcgtgtaccactactagctatattctgtgatgtaattccaatacatgtgtatggttttcctgtttaattaatgaaatacagtgttctttgaaagaaaaagggaaaaaaaat

SEQ ID NO: 339 - DNA, 984 bp, Oryza sativa
gcatctcaaacacaccacctgaattaacaagcaggtatatataagctactagctaattaagaagggcattagaatggcttcgtcttccttcctgctcctcgccactcttcttgccatggcctcatggcaaggcatggcttcggatcccagccctctgcaggacttctgcgttgccgacatgcactcacctgtgcttgtcaatggatttgcttgcctgaacccaaaggacgtgaacgcggatcacttcttcaaggcagcaatgttggacactcctcggaagacgaacaaagttgggtctaacgtcacactgatcaacgtcatgcagatccctggcctcaacacactcggcatctcaattgcacgtattgactatgcaccgttaggtcaaaaccctccccacactcatcctcgtgccaccgaaatcctcacggtgcttgaaggaacactctatgtcggcttcgtcacgtctaacccagataacaagtttttctccaaagtgctcaataagggtgatgtgttcgtattccctgtggggctcatccacttccaatttaaccctaacccctacaagcccgcggtcgcaattgccgcacttagcagccagaaccctggtgccatcaccattgcaaatgcggtgtttgggtcgaagccaccaatctccgatgatgttttggccaaggcattccaggtcgaaaaggggacaatagattggctccaagcccagttctgggagaacaaccattactgatcatcttactgattgcatttaagaaaaagttatgtgcagttacagagatcctgcataattaactttatatactacaataaaatgacttctatttcgtgtaccactactagctatattctgtgatgtaattccaatacatgtgtatggttttcctgtttaattaatgaaatacagtgttctttgtgacaaaaaaaaatagtgtcctgaagttcaatatgaaatcattatcagtgata

SEQ ID NO: 340 - DNA, 949 bp, Oryza sativa
aacccaacgataaacacaagcagttagctagcagctagctagcttctcagccaccagagaaacagcaaataattcagcagagaagagagcagaaaaccaaagccaagtaaatggcttcaccatccatctgcctcctcgctgctcttcttgcgttggtctcatggcaggccatcgcctctgatcctagccctctgcaggatttctgcgttgccgatatgcactcacctgtacttgtcaatggattcgcttgcttggacccgaagtacgtcaacgcagaccacttcttcaaggcagccatgctcgacactcctaggaagacaaacaaggttggatccaacgtcacactaatcaacgtcatgcagatccctggcctcaacacgctcggcatctcaattgcgcgcatcgactacgcaccattgggtgagaacccaccgcacacgcacccccgtgccaccgagatccttactgtcctcgagggaaccctctacgtcggcttcgtcacgtctaacccaaacaacacattgttctccaaggtgctcaacaagggtgatgtgttcgtgttccccgaggggctcatccacttccaattcaaccctaaccctcatcaacccgcagttgcaattgctgcactaagcagccaaaaccctggtgccatcactattgcaaatgcagtgttcggatcaaagccaccgatttcagacatagttttggcaaaggcattccaagttgaaaagggcaccattgattggctccaggctcagttctgggagaacaaccactattaattgccttaaaaaaattatgcttacagaatctatgttgtaatttcatatatagcataaataagtggtatgtattttgtatttcttatccgttcttccaaggtgtttgttctttacatttatgtactaatgtaaggccaatataatacatgtatggtttcccgtcg

SEQ ID NO: 341 - DNA, 991 bp, Oryza sativa
atcacccaacgataaacacaagcagttagctagcagctagctagcttctcagccaccagagaaacagcaaataattcagcagagaagagagcagaaaaccaaagccaagtaaatggcttcaccatccatctgcctcctcgctgctcttcttgcgttggtctcatggcaggccatcgcctctgatcctagccctctgcaggatttctgcgttgccgatatgcactcacctgtacttgtcaatggattcgcttgcttggacccgaagtacgtcaacgcagaccacttcttcaaggcagccatgctcgacactcctaggaagacaaacaaggttggatccaacgtcacactaatcaacgtcatgcagatccctggcctcaacacgctcggcatctcaattgcgcgcatcgactacgcaccattgggtgagaacccaccgcacacgcacccccgtgccaccgagatccttactgtcctcgagggaaccctctacgtcggcttcgtcacgtctaacccaaacaacacattgttctccaaggtgctcaacaagggtgatgtgttcgtgttccccgaggggctcatccacttccaattcaaccctaaccctcatcaacccgcagttgcaattgctgcactaagcagccaaaaccctggtgccatcactattgcaaatgcagtgttcggatcaaagccaccgatttcagacatagttttggcaaaggcattccaagttgaaaagggcaccattgattggctccaggctcagttctgggagaacaaccactattaattgccttaaaaaaattatgcttacagaatctatgttgtaatttcatatatagcataaataagtggtatgtattttgtatttcttatccgttcttccaaggtgtttgttctttacatttatgtactaatgtaaggccaatataatacatgtatggtttcccgtcgaataaattgaatgtgccaaaactctggaagaatatgtact

SEQ ID NO: 342 - DNA, 675 bp, Oryza sativa
atggcttcaccatccttctgcctactggcagctcttcttgcattggtctcttggcaggccatcgcatcagatcctagccctctgcaggatttctgtgttgccgacaaacactcgcctgtgcttgtcaatggatttgcttgcttggacccaaagtacgtgactgcagaccacttcttcaaggcagccatgctcgacactcctaggaagacaaacaaggttggatccaacgtcacgctgatcaatgtcatgcagatccctggcctcaatacgcttggcatctcaattgcacgcatcgactacgcaccattgggtgagaacccaccgcacacgcacccccgtgccactgagattctcactgtccttgagggaaccctctatgtcggcttcgtcacgtctaacccaaacaacacactattctccaaggtgctcaacaagggtgatgtattcgtattccccgaggggctcatccacttccaattcaaccctaacccccatcaacccgcggttgcaattgctgcactaagcagccaaaaccccggtgccatcaccattgcaaatgcagtgttcggatcaaagccaccgatttcagacaaagttttggcaaaggcgttccaagttgagaagggcaccatcgattggctccaggctcagttctgggagaacaaccactattaa

SEQ ID NO: 343 - DNA, 980 bp, Oryza sativa
gggcatcacccaacgataaacacaagcagttagctagaagctagctaattaaccttctcagccaccagagaaagaacaaataattcagtgcaaaagagagcagaaaaaaagtaaccacaaagccaaatggcttcaccatccttctgcctactggcagctcttcttgcattggtctcttggcaggccatcgcatcagatcctagccctctgcaggatttctgtgttgccgacaaacactcgcctgtgcttgtcaatggatttgcttgcttggacccaaagtacgtgactgcagaccacttcttcaaggcagccatgctcgacactcctaggaagacaaacaaggttggatccaacgtcacgctgatcaatgtcatgcagatccctggcctcaatacgcttggcatctcaattgcacgcatcgactacgcaccattgggtgagaacccaccgcacacgcacccccgtgccactgagattctcactgtccttgagggaaccctctatgtcggcttcgtcacgtctaacccaaacaacacactattctccaaggtgctcaacaagggtgatgtattcgtattccccgaggggctcatccacttccaattcaaccctaacccccatcaacccgcggttgcaattgctgcactaagcagccaaaaccccggtgccatcaccattgcaaatgcagtgttcggatcaaagccaccgatttcagacaaagttttggcaaaggcgttccaagttgagaagggcaccatcgattggctccaggctcagttctgggagaacaaccactattaattgtcctaaatattgtccgcttacggactctatgttttaattttacatacaaataaataagtggtatgtattttgttcttcctataaattcgcaaggtgttggctttttttaaagaaatgatgtacatgcattgttttaccgttcaataaatataatgcaatatatggtgtttgttacg

SEQ ID NO: 344 - DNA, 940 bp, Sorghum bicolor
tactggaatgccacctcactcactcacttatccactgcaaataattagaacagcacacaggatatatggcctcctcgtcttcctccttgctcctccttgcagcggccctccttgcgctagtagcctcttggcagcaggccatcgcctacgatcctagccctctccaggacttctgtgttgcagacaagaactcgcctgttcgtgtcaatgggtttccttgcaaggacccaatggccgtgaccccggacgacttcttcaacccagccatgatcatcgacaagcgcagggacaccaacaacaaggtgggatccaacgtcaccaacatcaacgtggagagcttcccgggcctcaacaccctgggcatctcgctagcgcgcatcgactacgcgcccctaggcgtgaacccaccccacatccacccccgcgccaccgagcttctcaccgtgctcgagggaaccctttaccttggcttcgtcacgtccaaccccaataggctcttctccaaggtggttaagaagggtgatgtctttgtcttccccaaagccatgatccacttccagatgaacctcgaccatgagaagccagcgacggccttgtcatcgctcagcagccaaaaccctggtgttattacgatcgctagcgcggtgtttggatcaaaaccaccgatctcagatgatgttttggccaaggctttccaggtggaaaagaaactcatagactggctccagtctcagttctgggataccaactactagtggttatacatgttgcaccaacacaagcgttacgtacatgtgcgccctatatatgtattgaataaattgcatgtggaggagtaatacttattattatgcgtgcgtgggagctgccagaagtatgtttgattgtattgtcactatctaatatacagaaaataagatttcattgaaaatctaatttt

SEQ ID NO: 345 - DNA, 949 bp, Sorghum bicolor
gccggccgggccgggaatgccacctcactcactcacttatccactgcaaataattagaacagcacacaggatatatggcctcctcgtcttcctccttgctcctccttgcagcggccctccttgcgctagtagcctcttggcagcaggccatcgcctacgatcctagccctctccaggacttctgtgttgcagacaagaactcgcctgttcgtgtcaatgggtttccttgcaaggacccaatggccgtgaccccggacgacttcttcaacccagccatgatcatcgacaagcgcagggacaccaacaacaaggtgggatccaacgtcaccaacatcaacgtggagagcttcccgggcctcaacaccctgggcatctcgctagcgcgcatcgactacgcgcccctaggcgtgaacccaccccacatccacccccgcgccaccgagcttctcaccgtgctcgagggaaccctttaccttggcttcgtcacgtccaaccccaataggctcttctccaaggtggttaagaagggtgatgtctttgtcttccccaaagccatgatccacttccagatgaacctcgaccatgagaagccagcgacggccttgtcatcgctcagcagccaaaaccctggtgttattacgatcgctagcgcggtgtttggatcaaaaccaccgatctcagatgatgttttggccaaggctttccaggtggaaaagaaactcatagactggctccagtctcagttctgggataccaactactagtggttatacatgttgcaccaacacaagcgttacgtacatgtgcgccctatatatgtattgaataaattgcatgtggaggagtaatacttattattatgcgtgcgtgggagctgccagaagtatgtttgattgtattgtcactatctaatatacagaaaataagatttcattgaaaatctaatttt

SEQ ID NO: 346 - DNA, 929 bp, Sorghum bicolor
  misc_feature (415)..(416): n is a, c, g, or t
aacactcgatatagtagattcatacacaagagaaagcatcagctctatagaagagatcaaaatcctttcttggtagacagaaatggcgtcgtccaacttctatcttctcagtgttcttctcattatgatcgcttccggcgctcgagctatggatccgagtcccctacaggacttctgcgttgcagacaaagactcgcctgtacgtgtgaatgggttgccctgcaaggatgttaaggatgtgaaggttgacgacttcttcctggcagccaaccttgacaagccaagggatacgacgatgagcaaggtcaagtcaaatgtcacgttgatcaatgtgatgaagctggccggtctaaacaccttgggcatctccatggctaggattgactatgctcctcaaggacagaacccaccacanntactcatccccgtgccactgagatcttaacagttcttgaaggttcactctatgttggttttgtcacatctaacccggacaacaaattttttagcaagctgctcaacaagggtgacgtttttgtgttcccacaaggcctaatccactttcagttcaatccaagtcatgacaagccagcggttgccatcgccgctctcagcagccagaaccctggtgccattaccatttctaatgcagtatttggatcaaaaccatcgatcgcggatgacgttcttgccaaggcgtttcaggtggacaagaaggttgtggattggctacaagctcagttttgggaggacaaccacaactaagtgaaggattctattgttatggtttttgcgtagcgatgtaataagtaacaacattggtttgatttgtttgtatgatgcagaaaactactgtatacctatattgccatatggattctgtaaaatgctatatatgaccttattagtcataaaattaaaatcatata

SEQ ID NO: 347 - DNA, 927 bp, Sorghum bicolor
aacactcgatatagtagattcatacacaagagaaagcatcagctctatagaagagatcaaaatcctttcttggtagacagaaatggcgtcgtccaacttctatcttctcagtgttcttctcattatgatcgcttccggcgctcgagctatggatccgagtcccctacaggacttctgcgttgcagacaaagactcgcctgtacgtgtgaatgggttgccctgcaaggatgttaaggatgtgaaggttgacgacttcttcctggcagccaaccttgacaagccaagggatacgacgatgagcaaggtcaagtcaaatgtcacgttgatcaatgtgatgaagctggccggtctaaacaccttgggcatctccatggctaggattgactatgctcctcaaggacagaacccaccacatactcatccccgtgccactgagatcttaacagttcttgaaggttcactctatgttggttttgtcacatctaacccggacaacaaattttttagcaagctgctcaacaagggtgacgtttttgtgttcccacaaggcctaatccactttcagttcaatccaagtcatgacaagccagcggttgccatcgccgctctcagcagccagaaccctggtgccattaccatttctaatgcagtatttggatcaaaaccatcgatcgcggatgacgttcttgccaaggcgtttcaggtggacaagaaggttgtggattggctacaagctcagttttgggaggacaaccacaactaagtgaaggattctattgttatggtttttgcgtagcgatgtaataagtaacaacattggtttgatttgtttgtatgatgcagaaaactactgtatacctatattgccatatggattctgtaaaatgctatatatgaccttattagtcataaaattaaaatcatata

SEQ ID NO: 348 - DNA, 869 bp, Sorghum bicolor
gcacgaggctcgctatagctgagttcggagacaacaagatggctccagccacctactttctcctcgtttcttttctagcattggtcacttctcaggccattgcttctgacccaagcccgctccaggacttctgtgttgccgacatacactctccagtgaaggtgaatggatttgtctgcaaggaccccatggctgtgaatgcagatgactttttcaaggcagcaaaccttgacaaacctagggacacaatgaaaagcaaggttggatccaatgtcactttgatcaatgtcatgcagttgcctggactcaacaccctaggtatctcgttggctcgcattgactatgcaccattaggtcagaatccgccacacacccacccacgtgccacggagattctcaccgtgcttgagggtacactctatgttggatttgtcacctccaacacagacaatggcaacaagctattcaccaaggttctcaagaagggtgatgtgtttgtattcccccaagggctcatccacttccaattcaatcctaaacatgacaagccagcagtcgcaatcgcggcactaagtagccagaaccctggggctataactattgccaacgcagtctttggatcaaagccaccaatctcagatgatgtcttggccaaggcattccaggtgcaaaaggggacaattgattggcttcaagctcagttctgggagaacaaccacaactaaataaatcatgttcggccattgtatgagttctgcaataatttgtatgggaatatagaatttttttgcactttacttactactgtatgttttcattatttctatgctactaatgataataaaataaatggtcagtatttctctact

SEQ ID NO: 349 - DNA, 1072 bp, Sorghum bicolor
tactggatcacaagacagacacaaacaccacaagctaagaagctccatagctgaattcagagactgcaaacacgtacaaaaagcgtgtgcaaaaccaaatggctgcctccagctacttcattctcgtttcttttgtagcatttgtcatttcacaggccactgcctctgaccctagccccctccaagacttttgtgttgccgacaaacattctccagtgaaggtgaatggatttgtttgcaaggacccaatggctgtgaacgcagatgacttcttcaaggcagcaaaacttgaccagcctagagacaccatgaagagcaaggtcggatctaacgttactttgatcaatgtcatgcagttgcctggactcaacacccttggcatctcgatggctcgcattgactatgcaccattaggtcagaatcctccacacacacatcctcgtgccacagagattctcaccgtgcttgagggtacactctatgttggatttgtcacctccaacacagacaacggtaacaagctattcaccaaggttctcaacaagggtgacgtgtttgtgttcccccaagggctcatacacttccaattcaacccagtccatgacaagccagctgtcgcgatcgctgcactaagcagccagaaccctggggctattactattgccaacgcggtctttggatcaaaaccgcccatctcagatgatgtcttggccaaggctttccaggtgcaaaagggaacaattgattggctccaagctcagttttgggagaacaaccacaactaagtaaattgggagtcacttcattgtatgaagataggtttatatatgtattttgcattactcccgtgtgtattcaattatgacatgctaagacaatatggtagaatagttaaatgggaagtgtatgtaaccaatcactatttttgtgtttctgctacaagctatatcaccatgttctagttgaatatttgaactgaagtacgtgaggatcctacataatttattggatattgtttgtatatgatatgccgttacatatatcaacaatatttcttgacattaatttggag

SEQ ID NO: 350 - DNA, 1076 bp, Sorghum bicolor
gcccccttggatcacaagacagacacaaacaccacaagctaagaagctccatagctgaattcagagactgcaaacacgtacaaaaagcgtgtgcaaaaccaaatggctgcctccagctacttcattctcgtttcttttgtagcatttgtcatttcacaggccactgcctctgaccctagccccctccaagacttttgtgttgccgacaaacattctccagtgaaggtgaatggatttgtttgcaaggacccaatggctgtgaacgcagatgacttcttcaaggcagcaaaacttgaccagcctagagacaccatgaagagcaaggtcggatctaacgttactttgatcaatgtcatgcagctgcctggactcaacacccttggcatctcgatggctcgcattgactatgcaccattaggtcagaatcctccacacacacatcctcgtgccacagagattctcaccgtgcttgagggtacactctatgttggatttgtcacctccaacacagacaacggtaacaagctattcaccaaggttctcaacaagggtgacgtgtttgtgttcccccaagggctcatacacttccaattcaacccagtccatgacaagccagctgtcgcgatcgctgcactaagcagccagaaccctggggctattactattgccaacgcggtctttggatcaaaaccgcccatctcagatgatgtcttggccaaggctttccaggtgcaaaagggaacaattgattggctccaagctcagttttgggagaacaaccacaactaagtaaattgggagtcacttcattgtatgaagataggtttatatatgtattttgcattactcccgtgtgtattcaattatgacatgctaagacaatatggtagaataattaaatgggaagtgtatgtaaccaatcactatttttgtgtttctgctacaagctatatcaccatgttctagttgaatatttgaactgaagtacgtgaggatcctacataatttattggatattgtttgtatatgataagccgttacatatatcaacaatatttcttgacattaatttggag

SEQ ID NO: 351 - DNA, 998 bp, Sorghum bicolor
tactggatcacagagacacacaaattgaacaagaagctctatagctgagttcgaagagcacaaacataaaagcaagtggaatactaatccagatggctcccacaacctactttctccttgtttcttttctggcattggtcacttctcaggccattgcttctgaccctagcccgctccaggacttttgtgtagccgacatacactctccagtgaaggtgaatggatttgtttgcaaggaccctatggccgtgaacgtggatgactttttcaaggcagcaaaccttgacaagcctagggatactatgaaaagcaaggtcggatccaatgtcactttgatcaatgtcatgcagttgcctggactcaacaccctgggcatctcactggctcgcattgactacgcaccattaggtcagaatccgctacacacccacccacgtgccacagagattctcaccgtgcttgagggtacactctatgttggatttgtcacctccaacacagacaacggtaacaagctattcacaaaggttctcaacaagggtgacgtgtttgtgttcccccaaggactcatacacttccaattcaacccagtccatgacaagccagctgtcgcgatcgctgcactaagcagccagaaccctggggctattactattgccaacgcggtctttggatcaaaaccacccatctcagatgatgtcttggccaaagctttccaggtgcaaaagggaacaattgattggctccaagctcaattctgggagaacaaccacaactaagtaaattgagactcacttcattgttcgaagataggtttatacatgtattttgcatactcccgtgtgtattcaattacgacattctaagctgatatgatagaataaatgggaagtttatgtaaccaatcactgtttttgtgtatctgctacaagatataccaccatgttctttttgaatatttgaattgaagtacgtgaggatcctacataattttctcg

SEQ ID NO: 352 - DNA, 1062 bp, Sorghum bicolor
tactggatcacagagacacacaaattgaacaagaagctctatagctgagttcgaagagcacaaacataaaagcaagtggaatactaatccagatggctcccacaacctactttctccttgtttcttttctggcattggtcacttctcaggccattgcttctgaccctagcccgctccaggacttttgtgtagccgacatacactctccagtgaaggtgaatggatttgtttgcaaggaccctatggccgtgaacgtggatgactttttcaaggcagcaaaccttgacaagcctagggatactatgaaaagcaaggtcggatccaatgtcactttgatcaatgtcatgcagttgcctggactcaacaccctgggcatctcactggctcgcattgactacgcaccattaggtcagaatccgctacacacccacccacgtgccacagagattctcaccgtgcttgagggtacactctatgttggatttgtcacctccaacacagacaacggtaacaagctattcaccaaggttctcaacaagggtgacgtgtttgtgttcccccaagggctcatacacttccaattcaacccagtccatgacaagccagctgtcgcgatcgctgcactaagcagccagaaccctggggctattactattgccaacgcggtctttggatcaaaaccacccatctcagatgatgtcttggccaaagctttccaggtgcaaaagggaacaattgattggctccaagctcaattctgggagaacaaccacaactaagtaaattgagactcacttcattgttcgaagataggtttatacatgtattttgcatactcccgtgtgtattcaattacgacattctaagactgatatgatagaataaatgggaagtttatgtaaccaatcactgtttttgtgtatctgctacaagatataccaccatgttctttttgaatatttgaattgaagtacgtgaggatcctacataatttattggatattgtttgtatatgatawgccgttacatatatcaacaatatttcttgacattaatttggag

SEQ ID NO: 353 - DNA, 882 bp, Sorghum bicolor
gctgagttcgagagcacaaactaaagagctagcgagcggaaaattaagccaaatggctcccgccacctactttctccttgtttctcttctagcagtagtcgcttctcaggccattgcttctgaccctagcccgctccaggacttctgtgttgcggacatacactctccagtgaaagtgaatggatttgtttgcaaggaccccatggccgtgaacgcagatgactttttcaaggcagcaaaccttgacaagcctagggacacaatgaaaagtaaggtcggatcaaatgtcactttgatcaatgtcatgcagttgcctggactcaacaccctgggcatctcgttggctcgcattgactacgcaccattaggtcagaatccgccacacacccacccacgtgccacagagatcctcaccgtgcttgagggtacactctatgttggatttgtcacatccaacactgacaacggtaacaagttatttgctaaggttctcaacaagggtgacgtgtttgtattcccacaagggctcatccacttccaattcaacccaatccatgacaagccagctgtcgcaatcgctgcactaagcagccagaatcctggggctattactattgccaacgcggtctttggatcaaaaccaccgatctcagatgatgtcttggccaaggccttccaggtgcaaaaggggacagttgattggcttcaagctcagttttgggagaacaaccacaactaaataaatcatgtttgggcattgtatcagttctggaataatttgtatgggaatatagagctttatttgcagtttacatactactgtatgtttttattatttcaattctactaatgataataaaataaatggttactatttctctg

SEQ ID NO: 354 - DNA, 1197 bp, Triticum sp.
tccgcgactggagcacgaggacactgacatggactgaacgagtagaaaatctatcacgccacaatcacaaacagaaacacaggagagagaaaaagatcagatggcatcatcctcttccttccttctccttgctgttcttcttgcgttggtctcatggcaggccactgcctccgatcctagccccctccaggacttttgtgtcgccgacatgaattcaccagtacgtgtcaatgggtttgtttgcaagaacccaatggaggtcaacgctgatgacttcttcaaggcagccgccctcgacaagcctagggtgaccaacaaggttggatccaacgtcactttgatcaacgtcatgcagattgctggactcaacaccctcggcatctcaattgcgcgcatcgactatgctcccttgggtcaaaacccaccacatacgcaccctcgcgccactgagatcctcacggtgcttgaggggacactgtacgttggctttgtcacatccaacaagcccgccccaaacagaaacaagttcctctcgaaggtgctcaacaaaggtgatgcgttcgtcttccccgtggggctcatccacttccaattcaaccccaacccccacaagcccgccgttgcaattgccgcgctcagcagccagaacccaggggctatcacaattgccaatgcggtgtttgggtcagacccacaaatatccgatgatgttcttgccaaggcgtttcaggtggaaaagaatacaatagactggctccaggctcagttctgggagaacaaccacaactaagtgaaacgttggctgattacacggaggaccagtgcgcaaattagggacatgtttgagtttgtagatatgcatcctaatctataaaataaatggagcatatgtcatcccattgttgtgtctgtaatgagtgaatttatttctaccttctgaataattgaaattatcattttttatcaagactaaaaaaaaaaaaaaaaaggggggccgctctaaaagtatccctcgagggggccaaggctttaccttacccagcttttttgtaccaagggggccctaatggggagtctattataagctaggacttggccggcgttttaaacgtccggaactggaaaaacttgtacttgggaatctttgtgaagaaccttaatttggtgggttgaaatattggcacaactacctaaaaa

SEQ ID NO: 355 - DNA, 1052 bp, Triticum sp.
aattcggcacgagcacaaacagaaataggaagtcgggagaacagaagagccaaagacactaaaacgaaatggcatcctcctcttccttccttctccttgctgcacttcttgcgttggtctcatggcaggccactgcttctgatcctagcccactccaggacttttgtgtcgccgacatgaattcaccagtccgtgtcaatgggtttgtttgcaagaacccgatggaggtcaatgcagatgacttcttcaaggcggccaacctcgacaagcctagggtgcccaacaaggttggatccaacgtcactttgatcaacgtcatgcagattgctggactcaacaccctcggcatctcaattgcacgcatcgactatgctcccttgggtcaaaacccaccacatacgcaccctcgcgccactgagatcctcacggtgctcgaggggacactgtatgttggatttgtcacatccaaccagcccgcccccaacagaaacaagttcctctccaaggtgctcaacaaaggtgatgtgtttgtcttccccgtggggctcatccacttccaattcaaccccaacccccaccagcccgctgttgcaattgccgcgctaagcagccagaacccaggggctatcacaattgccaatgcagtgtttgggtcagacccagcaatatcagatgatgttcttgccaaggcatttcaggtggaaaagaatacaatagactatctccaggctcagttctgggagaacaaccactactaagtcagacctttgttaattacccggaagaccagtgcacaagtgaaggacatggttgagttcctagatatgcttcctaatctataaaataaatggagcatacgtcatgccattgtgtgtctgtaattagtgaatgtatttctaccttctgaataattgacattattgtatttatcaaaaaaaaaaaaaaaggggcggcccgctctaaaagattccctcgaggggccaaagcttaccggtacccagctttttttggtaaaagggggcccctaaagggagtccgtttataaggcaagg

SEQ ID NO: 356 - DNA, 913 bp, Triticum sp.
aaaacacacaggaacagaagagaaaagaagagccaacgatactaaactcaaatggcaacctcctcttccatccttctccttgctgctcttcttgccttggtctcatggcaggccattgcctccgatcctggcccactccaggacttttgtgtcgccgacatgcattcgccagtgcgtgtcaatggatttgtttgcaagaacccgatggaagttaacgcagacgacttcttcaaggcagccaacctcgacaagcctagggtgaccaacaaggttggatccaacgtcactttgatcaacgtcatgcagattgctggactcaacaccctcggcatctcaattgcacgcatcgactatgctcccttgggtcagaacccaccacatacgcaccctcgcgccactgagatcctcacggtgctcgaggggacactgtatgttggctttgtcacatccaaccagcccgcccccaacagaaacaagctcctctccaaggtgctcaacaaaggtgatgtgtttgtcttccccgtggggctcatccacttccaattcaaccccaacccccaccagcccgctgttgcaattgccgcgctcagcagccagaacccaggggctatcacaattgccaatgcagtgtttgggtcggacccaccaatatcagatgatgttcttgccaaggcatttcaggtggaaaagaatacaatagactatctccaggctcaattttgggagaacaaccacaactaagtcagacatttgttgattacacggaagattagtgcataaaccaaggatttggttgaatttctcgggcatacttatctataaaataaatggagaatatgtcatgttgctgtgtgtctgtaagccatgaatgtatttcaatgttatgaataatcaacaatatcttgtttcatca

SEQ ID NO: 357 - DNA, 923 bp, Triticum sp.
cacacacagggaaaacaagagaaaagacgagtgaaagaagctcaaatcaaatggcatcctccccttccttccttctcctcgccgctcttcttgccttggtctcatggcaggccgttgcctccgaccctggccctctccaggacttttgtgtcgccgacatgcattcaccagtacgtgtcaatgggtttgtttgcaagaacccaatggaggtcaacgctgatgacttcttcaaggcagccgccctcgacaagcctagggtgaccaacaaggttggatccaacgtcactttgatcaacgtcatgcagattgctggactcaacaccctcggcatctcaattgcgcgcatcgactatgctcccttgggtcagaacccaccacatacgcaccctcgcgccactgagatcctcacggtgctcgaggggacactgtacgttggctttgtcacatccaaccagcccgccccaaacagaaacaagttcctctccaaggtgctcaacaaaggtgatgtgtttgtcttccccgtggggctcatccacttccaattcaaccccaacccccacaagcccgccgttggaattgctgcgcttagcagccagaacccaggggctatcacaattgccaatgcggtgtttgggtcggacccacaaatatccgatgatgttcttgccaaggcgttccaggtggaaaagaatacaatagactggctccaggctcagttctgggagaacaaccacaactaagtgaaacgttggctgattacacggaggaccagtgcacaaattaaggacatgtttgagtttctagttatgcatcgtaatctataaaataaatgcagcatatgtcattccattgttgtgtctgtaatgagtgaatgtatttctaccttctgaataattgataatatcattttttatgacactgat

SEQ ID NO: 358 - DNA, 1142 bp, Triticum sp.
ccacgcgtccgaacaaacacaacaggaatacacaagagaaaagaagacccaaaggagctgaaatcaaatggcatcctccccttctttccttctcctcgctgctcttcttgccttggtctcatggcaggccgttgcctccgatcctggcccgctccaggacttttgtgtcgccgacatgcaatcaccagtgcgtgtcaatggatttgtttgcaagaacccgatggaggtcaacgctgatgacttcttcaaggcagccgccctcgacaagcctagggtgaccaacaaggttggatccaacgtcaccttgatcaatgtcatgcagattgctggactcaacaccctcggcatctcaatcgcgcgcatcgactatgctcccttaggccagaacccaccacatacgcacccccgcgccactgagatcctcacggtgctcgaggggacactgtacgttggctttgtcacatccaacctgcccgccccagccagaaacaagttcttctcgaaggtgctcaacaaaggtgatgtgtttgtcttccccgtggggctcatccacttccaattcaaccccaacccccaccagcccgccgttgcaattgccgcgctcagcagccagaacccaggggctatcacaattgccaatgcggtgtttgggtcagacccaccaatatccgatgatgttcttgccaaggcgtttcaggtggaaaagaatacaatagactggctccaggctcagttctgggagaacaaccacaactaagtgaaaggttggctgattacacagaagaccagtgtgcaaattaaggacatgtttgagtttctagatatgcatcctaatctataaaataaatggagcatatgccatttcattccatgtctgtaatgagtgaatgtacttctaccttcagaatattgacaatatcgtggttatcacacggatatgatctcatattattatttttggttctaggaaaaagataaaaaaacaaaaactgtcggcggctcggcctcgactctagactcgagcagcttatgcatgcggcgcatccagctatggcatcgctagtgagtcgattacatcatgcgtcgtttaccgcttgactgacctggcgtacaactatcctggaaacaattcccccttcgcc

SEQ ID NO: 359 - DNA, 911 bp, Triticum sp.
ccacgcgtccgggaatacgagagaacagaagagccaaagacactaaaacaaaatggcatcctcctcttcctttctcctccttgctgcacttcttgcattagtctcatggcaggccactgcttctgatcctagcccactccaggacttttgtgtcgccgacatgaattcaccagtccgtgtcaacgggtttgtttgcaagaacccgatggaggtcaacgcggacgacttcttcaaggcggccaacctcgacaagcctaggatgcccaacaaggttggatccaacgtcactttgatcaacgtcatgcagattgctggactcaacaccctcggcatctcaattgcacgcatcgactatgctcccttgggtcaaaacccaccacatacgcaccctcgtgccactgagatcctcacggtgctcgagggaacattgtacgttggttttgtgacatccaaccagcccgcccccaacaaaaacaagttcctctccaaggtgctcaacaaaggtgatgtgtttgtcttccccgtggggctcatccacttccaattcaaccccaacccccaccagcccgctgttgcaattgccgcgctaagcagccagaacccaggggctatcacaattgccaatgcagtgtttgggtcagacccaccaatatcagatgatgttcttgccaaggcatttcaggtggaaaagaatacaattgactatctccaggctcagttttgggagaacaatcactactaagttagacattttttgattacccggaaagattagtacataaaccaaggatttggttgaacttctgaagcatccttatctataaaataaatagagaatatgtcatgccattgtatgtctgtaagccatgaatgtatttcaatgttatgaataatcaacaatatcttttttc

SEQ ID NO: 360 - DNA, 992 bp, Triticum sp.
ggggaaaccarcmckcacatacaccacaatcacaaacaggaacacaagagagagagagagagagagagagagagaagaagagagagaaaacaaatcagatggcatcctcctcttacttccttctcctcgccgctcttgttgcgttggtctcatggcaggccactgcctccgatcctagccccctccaggacttttgtgtcgccgacatgaattcaccagtaccgtgtcaatgggtttgtttgcaagaacccgatggaggtcaatgcagatgacttcttcaaggcggccaacctcgacaagcctagggtgaccaacaaggttggatccaacgtcactttgatcaacgtcatgcagattgctggactcaacaccctcggcatctcaattgcgcgcatcgactatgctcccttgggtcaaaacccaccacatacgcaccctcgcgccactgagatcctcacggtgctcgaggggacactgtacgttggctttgtcacatccaaccagcccgcccccaacagaaacaagttcctctccaaggtgctcaacaaaggtgatgtgtttgtcttccccgtggggctcatccacttccaattcaaccccaacccccaccagcccgctgttgcaattgccgcgctcagcagccagaacccaggggctatcacaattgccaatgcagtgtttgggtcagacccaccaatatcagatgatgttcttgccaaggcatttcaggtggaaaagaatacaatagactatctccaggctcagttctgggagaacaaccactactaagtcagacctttgttaattacccggaagaccagtgcacaagtgaaggacatggttgagttcctagatatgcatcctaatctataaaataaatggagcatatgtcatgccattgtgtgtctgtaatgagtgaatgtatttctaccttctgaataattgacaatatcattttttatcatgtatttatcacactaacaaaaaaaaaa

SEQ ID NO: 361 - DNA, 967 bp, Triticum sp.
cagaaggtagaaatacagacactcacatacaccacaatcacaaacaggaacacaagagagagagagagagagagagagagagagagagagaaaacaaatcagatggcatcctcctcttacttccttctcctcgccgctcttgttgcgttggtctcatggcaggccactgcctccgatcctagccccctccaggacttttgtgtcgccgacatgaattcaccagttcgtgtcaatggctttgtttgcaagaacccgatggaagttaatgcagatgacttcttcaaggcagccaacctcgacaagcctagggtgaccaacaaggttggatccaacgtcactttgatcaacgtcatgcagattgctggactcaacaccctcggcatctcaattgcgcgcatcgactatgctcccttgggtcagaacccaccacatacgcaccctcgcgccactgagatcctcacggtgctcgaggggacactatacgttggctttgtcacatccaaccagcccgccccaaacagaaacaagttcctctccaaggtgctcaacaaaggtgatgtgtttgtcttccccgtggggctcattcacttccaatttaaccccaacccccacaagcccgccgttgcaattgccgcgcttagcagccagaacccaggggctatcacaattgccaatgcggtgtttgggtcagacccacaaatatccgatgatgttcttgccaaggcgtttcaggtggaaaagaatacaattgactggctccaggctcagttctgggagaacaaccacaactaagtgaaacattggctgattacacggaggaccagtgcgcaaattaaggacatgttcgagtttctagatgtgcatcctaatctataaaataaatgtaggatatgtcattccattgtgtgtctgtaatgagtgactgtatttctaccttctgaataattgacaaatatcattttttatc

SEQ ID NO: 362 - DNA, 1760 bp, Zea mays
ccccaaaaaatagagggaaaggaggaaggagggggagatttttttttacaagcccacagtgagaccccccccaaaaggagggccccccacccctcccaaactaggggacccccccttggttgaaaaaaatgtcaggttttttaccggggcaaaaaagttttgaaaattttcaaaagaaaagggcctacaaggtttaaagggtatacccccccagggcccaaaaaatttgcccctcttacaaaaaaaaaaaccccacggaaaacccttttgggaaatcccccgggaacttgttaggcacacacgtctatgccatccacggaccatggtgtgccctctacttatcctcctctcggctacctccaccattcctctgctcagctcgaacgaacaaaaaggactcacctcggccctctcctcttgtgcttctgcttccccaccgagtctcctcaaccccaggcactcgccctctgtcccctcccttcctcgcctccgatgccgccgccgccgccgctcctcgagccgcgcgactacctcggcgccggcgccacctcgtcgtgctgctcgtcgtgctgctcctccggccgcgagggcgcggggccccacctcgcgctgcggctcgggcttccggggtccgacgactcccccggccgcggcgcggacacggagcacgcccgcgcccacgtcgacgccgcgctcaccctcggccccggccccggccccgcgcctcccaggggcagcgccaagcgcgggttcgccgactccctcgaccggtccgcgaagctggacggcgttgccgcggatgacgctgctgggggcgtcacgcgggtagctggagctgctgccggagctccgcccgctgccaaggcacaagttgttggatggccgcctgttaggagctaccggaagaataccctagctgccagtgccacaaagacaaatgggggagatgaaggtaggagtgaggcgggatgctgttatgtcaaggtcagcatggatggagccccatacctaaggaaggtggacctcaagacctattcaagctatgaggatctctcgcttggtctggagaaaatgttcagttgcttcatcactggtcaaaacagttcatgcaagacttcaagaagggataggcttactgatggttctagggttgatgcccttcaggaccaagaatatgtccttacttacgaagataaagatgctgactggatgctcgttggtgatctgccctgggacttgttcaccacattttgccggaaacttaggatcatgagaggctctgatgctgctggcatggctcctccaagaccmccggaacagacagttcggaacaaatgagggcggrcagcttacttacctggcgctgaactgaagggagagcgacgctgccttggtcaggccttctttcacttgtgcagtgggatctgcgtcctgctgtctcggacgcccattttgcccacgagctggtcgtcacgtgctgtcgctttttgtctgggaaagatagcgtactgcttgctgtatgatactttcatctgtgttcggaagtttgtagcgcttcatatcctggaagggagtaaagaaaatgtccatgctgtccggtgagaatttctttccccgtgctgtgtctgcgagtcaaactaactattgagcgatatgagcatgcattggcatcagtttacctgccakwwwsctgmmmmaatactaaaaatgaagaaaagaaaagcaaaaaaataaaggggcggccgccgactagggagctc

SEQ ID NO: 363 - DNA, 1355 bp, Sorghum bicolor
  misc_feature (541)..(541): n is a, c, g, or t
  misc_feature (1320)..(1320): n is a, c, g, or t
acttctcactgtcatggtgccggtgccctctccgtctcctccttctttaacaaggcaccaccaccaccagcacctctccagacgaacgaacaaaaagaggcctcgcacctcgctcgctcgctcgccttcctgctgtgcttctgcttccccagcgacagcgagtctcctcaacctcagcccctcccctcccttcgccgccgcctgcgactccgatgccgccgccgctcgaggcgcgcgacttcctcggcgccggcgccacctcgtcgtgctgctcgtcgtcctgctcctccggcggcgatgggacggtgccgcacctcgcgctgcggctcgggctcccggggtccgactcccccggccgaggcgcgcaggcggagcacgcccacgtggacgccgcgctcaccctcggccccgcccccgcccccgcgccgcccaggggaggcgccaagcgcgggttcgccgactccctcgaccggtccgcgaagcgggacggtgctgcggcggatgacgacgctgctgggggcgtaactggggaggataaggnggtagctgcggccgctgccggagctccgccggctgccaaggcacaagttgttggatggccacctgttaggagctaccgaaagaatacactagctgcaagtgccacaaagacaaaggtggaagatgaaggtaggagtgaggcgggatgctgttatgttaaggtcagcatggatggagccccatacctaaggaaggtagacctcaagacctattcaagctatgagaatctctcgcttggtctggagaaaatgttcagctgcttcatcactggtcaaaacagttcttgcaagacatcaagaagggataggtttactgatggttctagggctgatgcccttcaggaccaagaatatgtccttacttacgaagataaagatgctgactggatgcttgttggtgatctgccctgggacttgttcaccacaatttgtcggaaactaagaatcatgagaggctctgatgctgctggcatggctccaagatcactggaacagatagctcggaacaaataaggaatgttgcccgacagacacagtctgaactaaggacagagtttacatggcgctgaagggagcgatgttttatgcgaagtgcttcggttaagtcttcttttcacatgtgcagtgagatctgtggcctactgtaagacgcccattttgcccacgaggttgtcacgtgttattgtagatggtcgcttttgtctgtgaaagatcaaatccggtagcctactgcttcctctatgatactttcatctgtatccggaagtttgtacttcatttncctataacagtaaaaaaagtgcccatttgtccagt

SEQ ID NO: 364 - DNA, 864 bp, Zea mays
gaattccattgtgtcggggtgttcttgatcgattaagctgtcctcaaccatcatggctgccattatggcggcaggtctggtagtactggcactcctcgctgccgtcgccgctccggcgcacgccacggactacgtggtgggcgactcggccgggtgggccagcggcgtggactacgccacctgggcgagcggcaaaaccttcgctgctggggacaacctagtgttccagtacagcgcgatgcacacggtggcggaggtgagctccgcggactacagcgcctgctcggccagcaactccatccagtcctacagcgaccagaacaccaaggtcgcgcttacggcgcccggcacgcgctacttcatctgcggcgccccgggtcactgcggcaacggcatgaagctcaccgtcacggtcgccgccgcggccgccaccaccaccccggagacgtccacgtctacgcccgccgcaacgacgacgcccaccacgaccaacgctgacacgcccaacgctgacacgcctccggagacgtccacgtctacgcccgccgcaacgacgccgcccaccacgaccaagtccacgtccacctcgagcactagcagcactggtgctgcctgcggtggggaggcccggctcggtatgggcattttggccgcggccgcgggcctcgccgggctcgccctgatgggctaggctaggcaagaggcagtgctgtttcggttttccttatgtcccctgcttttcctgttggttgcagccctgtagcccattgtgtttactgtctacgcaccctcctccattcacgtttatgctcacgatggcttgttcgaggctcctgctgaatacatgtacgatcattcttactg

SEQ ID NO: 365 - DNA, 906 bp, Zea mays
cattgggtacctcgaggccggccgggccgggactcagtggtgcccacagctaaagccttgtgcaaaattatcattaagctgtcatcaatcatcatggctgccattacggcaggtctgctggtactcctcgctgctgccgtcgccgctccggcgcacgccacggactacacggtcggcgactcgtccgggtggagcagcggcgtggactacgccacctgggcgagcggcaagaccttcgctgctggggacaacctagtgttccagtacagcgcgatgcacacggtggtggaggtgagctccgcggactacggcgcgtgctcggccagcaactccatccagtcctacagcgaccagaacaccaagatcgcgctcacagcgcccggcacgcgctacttcatctgcggcaccccgggccactgcggcaacggcatgaagctcgccgtcacggtcgccgctgggaccgccaccaccaccccggcgtcatccccgcccgccgctgactcgcctccagagacagccacgccgtccgggtctacgcccacggcaacgacgtcgccgtcggcgcccacgacgaagcccacctcgagcagcactggcgctgcctgcggtggggaggcccggctcgctatgggcgttttggcctgggccgcgggcctcgccgggctcgccctgatgggttaggcaagaggcagtgctgtttccgttccatgcttttcctgttgcaggcttttgtggcccgttgtgtttaatctgaattcacgtctatggtctatgctcgattctggcttgttcgagactcccgctgtatacatgtacggctatccttgaatccttcatgctggacctgtcccagcggtctgcaatatgtcatagataacgatatgctatggctatttaatcgttcta

SEQ ID NO: 366 - DNA, 840 bp, Sorghum bicolor
gcacgaggccaccatcagctaagcaaagcaggccatctgccaaagtctacctgtgtccatctaacaaagccagccgggtggtccgtgttcttgattaagctgtctgcaatcatcatggctgccgccatcatggcaggtctgctgatactcctcgctgccgtcgccgctccggcgcacgccaaggattacaccgtcggcgactcgtccgggtggaccagcggcgtcgactacaccacctgggcgagcggcaaaaccttcgctgttggcgacaacctagtgttccagtacagcatgatgcacacggtggcggaggtgagctccgcggacttcaacgcgtgctcggccagcaacgccatccagtcctacagcgaccagaacaccaagatcgcgctcacggcgcccggcacgcgctacttcatctgcggcacggcgggccactgcggcaacggcatgaagctcgccgtcacggtccccgctgcggccgccaccaccccgccggcgtcgtcatccccgcccaccacgccggcggcgcccggcgccgacacgcctccggagacgaccacgccgtccacgtccacgcccaccgcgacgtcgccgcccaccgcgaccaagcccacatcgagcagcgctgccgctgcctgcggtggggaggcccggctcgctatgggcatgttggccggcgccgcgggcctcgctgggctcgccctgatgggctaggcaaaaggcagtgctgtttccatgcttttcccgttggttgttggaggcttgtgggcttctggcccattgtgtttatttactatttattacgcactctgaatttcacgtttatgctcgcgaatg

SEQ ID NO: 367 - DNA, 1086 bp, Hordeum vulgare; identical to SEQ ID NO: 43

SEQ ID NO: 368 - DNA, 1221 bp, Hordeum vulgare
cggcacgagggagagatccttggtctgcagcgcgcccgagctgagcgtaggcaggcgggcgaagatgctcgacatccagaagcggcgcgtccagcttctgctcttcgtcaccggcgtgctcgccctcagcatgacagctgagaagtgcagggaacttgtcggaaaggaggctgcatcaaagagtgggcagttcacattcatgaactgtttcgatatgggatcgggcagccttgcatgtgcagggaaggagggggtgaagctgtatgtgaacaacatccgaagtgcacacatggaaagggtgcggcagcgagcccttgagaaagcgttggctgatgctttgacagaaggcctgagtcctgctgaggcagccaagcaagctcagaaggtcggggcgaaagcgacgaaggtggccgctcgtcaagcgaagaggatattggggccgataatttcctctggctgggacttcttcgaggcaatgtatttcggtggaagcatgactgaaggttttctccggggcacgggcaccttattcggaacctatgcgggcggtttccatggtgaggagaggctgggaaagcttggctatcttgctggaagccagctaggcagctgggtcgggggaagaatcggactgatggtctacgatgtcatcaacgggttgaactatatgcttgagtttgtccgtccagaggagtaccggcgatcatcatcatcatctcattatgcatcagaagagggttcagagtatttagatgactacagaagcggcgaaggatatgagccaacattcagtgagacgctagaagaggcgcaggaggaggaggaatcgcggggtttcagcttgttctgaaacctgaagcttggatatcaggcgacttacactgggatggcagcaggccaagaagcaagcaccacctatactgaacttgtttttgcatttctagatgagggagtgattcttgtctgtaattcttgtatggcgattgtgtataatagaaacgtttgcgtgcaaccatggctgtggctgcatggtctatacagcagaggtactgagcatcatcaacaaagaagaatcacatttggtctgggagtatcttgtactactagcgcacttggggaaacaggaggtctctagagtgaatttggggtatatgtgtctgtcagttcgtttctaatttaacatagtttggcagatgccacttcgtttagcagcggccgcca

SEQ ID NO: 369 - DNA, 1185 bp, Zea mays
ctctttatttctccctcgcttccggcctcccctattcctccggtcgacgtgagagagcggaaggttggtctgtaggcagggttagatcctcgcgacgctcgatcctgacggtggtgggcgaagatgttggacatgcagaagcggcgcgtgcggctgctgctcttcatcacgggcattctggcgctcagcatgaccgctgagaagtccagagaacttgttggaaaggaggctgcatcaaagagtggtcaatccacattcatgaactgctttgacaagggctctggcagccttgcatgcacatcaaaggagggtgtcaagttgtacgtcaacaacattcgaagtgcacacttggaaatggtgcgacagcgacccatggggaaagctttagctgatgctgtggcagaaggcctaacacctagcgaagcagccaaacaagctcagaaggttagtgcaaaagcgacaaaaattgccgctcgtcaagcaaataggatattggggccaataatttcttgtggttgggacttcttcgaagcaatgtactctggcggaagcatgatggaaggttttcttcggggcactggcaccttgtttggaacttatgtgggtggtttccatggtgaggagcggtttgggaagctggggtatcttgcaggaagccatgtcggaagctggggtggaggaagaattggattgatgatttatgatgtcataagcggactgaaatatatgttcatgtctgtccaacctaagtatgaatcatcgtcatatgcatcagaagatggtccagaatacgcaaaaagatatacaaatcaagaggagccaacatactatgaaccatcaaaggaaaagcaagaagaatcaaaatggtttggtttgttctaaatctatgaaccgaagtgttccgtcttaaactcaagggcggagctaggtagtagctagattgttgcaccccccccccccctaaaaatgtgaaaatggtgtctttcaccaaaagtccaccatatatgcacccatgaggcaattgtactcatcactgcttcgctactggagcatgaaacaattagcttgttttgttgtacatttctgaatgttcagcttcattttgtatggttacctagattaggtgtgattcttcattgtaattcttgttttggctaccatgtatataaaacatatgtatcgact

SEQ ID NO: 370 - DNA, 1328 bp, Zea mays
attgggtccctcgaggccggccgggacgctcaacacgtggcggcagcgaagagaatggtgcgaccatttctcttctcttctcttctcttccctggacttgtctctctctttattcctccctcacttccggccttccccttttcctccggtcgacgcgagggagcgggaggttggcctctaggcagggtggcgggcgaagatgttggacatacagaagcggcgcgtgcggctgctgctcttcatcacggccgtcctcgcgctcagcatcaccgctgagaagttcagggaacttgttggaaaggaggctgcatcaaagagtggtcaattcacattcatgaactgctttgacatgggctctggcagccttgcgtgcactgcaaaggagggtgtcaagttgtacgtcaacaacatccgaagtgcacacttggaaatggtgcggcaacgagccatggagaaagctttagctgatgctgtgacggaaggcctaacacctagtgaagcagccaaacaagctcagaagattagtgcaaaagcgactaaacttgctgctcgtcaagccaaaaggatattgggaccaataatttcttgtggttgggacttcttcgaagcaatgtactttggtggaagcatgacggaaggttttctccggggcactggcaccttgtttggaacttatatgggtggtttccatggtgaggagcgctttgggaagctgggatatcttgcaggaagccatctaggaagctggggtggaggaagaattggattgatgatttatgatatcataagcggcctgaaatttatgttccagtctatccaacctgagtatgaatcatcttcatatgctgaagatggtccagaatacgcagaaagttacacaaaccaagaggactcaacatactatgaaacatcagaggaaaagcaggaagaatcaaaatggtttggtttgttctgaaactgcgaaccgaattgttctgtcttgtacttaggggcgaagctaggtagtagctggagtgttgcaccccctgaaaatgtgaaaacagtgctttccactgaaatttcaccatatatgtatccacaaggcaagtgtactcactaatttgctctagcttcgccacagttatactggagcaggggaacagttagctgttttattatacctttctgaatgtttagcttcattttgtatgcttacataggttaggtatgattcttctctgtaattcttgttttggctactgtgtacataaaacatatggatcaactctggagattgggcaggcagaatgcaccataaataacagcaacagtgaacacttacggaaaaa

SEQ ID NO: 371 - DNA, 1290 bp, Zea mays
ggcggcagcgaagagaatggtgcgaccatttctcttctcttctcttctcttccctggacttgtctctctctttattcctccctcacttccggccttccccttttcctccggtcgacgcgagggagcgggaggttggcctctaggcagggtggcgggcgaagatgttggacatacagaagcggcgcgtgcggctgctgctcttcatcacggccgtcctcgcgctcagcatcaccgctgagaagttcagggaacttgttggaaaggaggctgcatcaaagagtggtcaattcacattcatgaactgctttgacatgggctctggcagccttgcgtgcactgcaaaggagggtgtcaagttgtacgtcaacaacatccgaagtgcacacttggaaatggtgcggcaacgagccatggagaaagctttagctgatgctgtgacggaaggcctaacacctagtgaagcagccaaacaagctcagaagattagtgcaaaagcgactaaacttgctgctcgtcaagccaaaaggatattgggaccaataatttcttgtggttgggacttcttcgaagcaatgtactttggtggaagcatgacggaaggttttctccggggcactggcaccttgtttggaacttatatgggtggtttccatggtgaggagcgctttgggaagctgggatatcttgcaggaagccatctaggaagctggggtggaggaagaattggattgatgatttatgatatcataagcggcctgaaatttatgttccagtctatccaacctgagtatgaatcatcttcatatgctgaagatggtccagaatacgcagaaagttacacaaaccaagaggactcaacatactatgaaacatcagaggaaaagcaggaagaatcaaaatggtttggtttgttctgaaactgcgaaccgaattgttctgtcttgtacttaggggcgaagctaggtagtagctggagtgttgcaccccctgaaaatgtgaaaacagtgctttccactgaaatttcaccatatatgtatccacaaggcaagtgtactcactaatttgctctagcttcgccacagttatactggagcaggggaacagttagctgttttattatacctttctgaatgtttagcttcattttgtatgcttacataggttaggtatgattcttctctgtaattcttgttttggctactgtgtacataaaacatatggatcaactctggagattgggcaggcagaatgcaccataaataacagcaacagtgaacacttacggaaaaa

SEQ ID NO: 372 - DNA, 1243 bp, Oryza sativa
cggagttgacgctgcgaccattcttttttatttattctttcttttttcccttcctccctcctcctcctcctcctccggtggatgcgatccgcgagggcaatcgatctccgcagcgtctgaggcaaggggcgtaggaggagggcgaagatgctggacatccagaagcgacgcgtccagctgctgctgttcatcgtgggcgtcctcgcgctcagcatgaccgctgagaagttcagggaacttgtcgggaaggaggaagcatcaaagagtggacagtttacgttcatgaactgttttgatatgggctcaggcagccttgcgtgcgcagtgaaggagggcatcaagttgtatgtctacaacctccaaactgcacatacggaaagggtgaggcaccgggccattgagaaagcattggctgatgctgtgacagaaggcctgtctgccgctgaggcagcaaagcaagctcagaaggttggtgcgaaagccgcaaaagtggcagctcgtcaagccaagaggatattggggccgataatttcttctggttgggacttctttgaagccatgtacttcggtggaagcatgactgaaggttttctccgaggtaccggcaccctatttggaacctatgtaggtgggttccatggtgaggagaggctggggaggtttggttatcttacaggaagccatctgggcagttgggttggtggaagaattggattgatgatttacgatgtcataaatggcttgaagtatatgcttcagtttgtcaagccagagtatgaagcatcagcatattattcaaaagagagtacagagtatgcatatagttatagaagtggggaaagagaggagccaacatattatgagacatcagaagagaatcaggaggaatcgcaggggttcagtttgttctgagactgcaaactttgatactagcatagcatgtctccttttgagtaacacgtttaggtttttttttggtatttttaagtgaggatatgattcttctatgtaattcttgtttcagccactgtatataaaaacccttgcggtcctgccaaatggtaaaaagatagcagtgatgttgaacgtctacagaataacatagggatgtatatcatattcagatatgttttagggagcatatgtctccaacgtttgtttcctgtttatgtattcctgttccacttcaaagatagtttccaatttgacaaagttgagcaaatgccaagcatttcagttactg

SEQ ID NO: 373 - DNA, 1105 bp, Sorghum bicolor
gcacgaggctcccttccctgttcctcggtggacgcgagggagcgggaggttggtccgtaggcagggttagatcctcgcggcgctcgattccgacggtggcgggcgaagatgttggacatacagaagcggcgcgtgcggctgctgctcctcatcacgggcgtcgttgcgctcagcatgaccgctgagaagttcagggaacttgttggaaaggaggctgcatcaaagagtggtcaattcacattcatgaactgctttgacatgggctctggcagccttgcatgcacagcaaaggagggtgtcaagttgtacgtcaacaacatccgaagtgcacacttggaaatggtgcggcagcgagccatggagaaagctttagccgatgctgtgacacaaggcctaacacctggtgaagcagccaaacaagctcagaaggttagtgcaaaagcaacaaaagttgctgctcgtcaagccaataggatattggggccaataatttcttgtggttgggacttcttcgaagcaatgtactttggcggaagcatgacagaaggttttctccggggcactggcaccttgtttggaacttatgtgggtggtttccatggtgaggagcggtttgggaagctcggatatcttgcaggaagccaaatagggagctggggtggaggaagaattggattgatgatttatgatatcataagcggcctgaaatatatgtttctgtctatccaacctgagtatgaatcatcttcatatgcctcagaatatggttcagaatacacagaaatttatacaaaccgagaggagtcaacatactatgaaacatcagaggaaaagcaggaagaatcaaaatggtttggtttgttctgaaactgctaactgaagtgttctgtctcatactcaggggcgaagctagagtgttgcaccccccaaaaatagtgaaaaccgtggttttcactaaaatttcaccatatatgtacccmaraggcatgkstrctcctcwctaattkgctckrgctktgccragcmcgswaacwgttrgcctstktygytwtmcmtgtctgaatgtttagcttcattttgtttggttacgtagatttggtatgat

SEQ ID NO: 374 - DNA, 1201 bp, Triticum sp.
ttcgtttcttccccactcctcctcctcctcccacgagaggagagatccttggtctgctgcscgccgagccgagcgtgggaggccgcgaagatgctcgacatccagaagcggcgcgtccagcttctgctcttcgtcgccggcgtgctcgccctcagcatgacagctgagaagtgcagggaacttgtcggaaaggaggctgcatcaaagagtgggcagttcacattcatgaactgtttcgatatggggtcaggcagccttgcatgcgcggggaaggagggggtgaagctgtatgtgaacaacctccgaagcgcacacatggaaaacgtgcggcagcgagccatcgagaaagcgttggctgatgctktgacagaaggcttgagtcctgctgaggcagccaagcaagctcagaagatcggggcaaaagcgacgaaggtggccgctcgtcaagcgaagaggatattggggccgataatttcctstggctgggacttcttcgaggcaatgtactttggcggaagcatgacagaaggatttcctmcggggcaygggcaccttattcggaacctatgcgggtggtttccatggcgaggagaggctgggaaagcttggctatctcgttggaagccagctaggcagctgggttgggggaagaatcggactgatggtctacgatgtcatcaacgggttgaactacatgcttgagtttgtccgtccagaggagtaccgatcatcatcttattatgactcagaagagggctcagagtatgcagataactacagaagtggcgaaggagatgagccaacatttagtgagacgctagaagaggcgcagcaggaggaggaatcggggggtttcagcttgttctgaaacttgaagcttggatatcagccgacttacactgggatggcagcaggccagcaagcaagcaccacttattctgaacttgtttttgcatgtctagatggggaagtgattcttctctgtgattcttgtatggccattgtgtataatagaaacgtttgcatgcaaccacggctctggctgcatggtctaaagagctaaacatgaacaaagaacacatctggagtatcttgtagcatacttggggaacacaggtctctagagtgaatttgctgtatacgtgtctgtcagttcgtttataatttaatttaacatagttgggcagatgccccttcattt

SEQ ID NO: 375 - DNA, 1239 bp, Triticum sp.
cccacttcctcctcctcctcctcccacgagaggagagatccttggtctgctgcccgccgagccgagcgtgggaggccgcgaagatgctcgacatccagaagcggcgcgtccagcttctgctcttcgtcgccggcgtgctcgccctcagcatgacagctgagaagtgcagggaacttgtcggaaaggaggctgcatcaaagagtgggcagttcacattcatgaactgtttcgatatggggtcgggcagccttgcatgcgcagggaaggagggggtgaagctgtatgtgaacaacctgcgaagcgcacacatagaaaccgtgcggcagcgagcccttgagaaagcgttggctgatgctttgacagaaggcttgagtcctgctgaggcagccaagcaagctcagaagatcggggcaaaagcgacgaaggtggccgctcgtcaagcgaagaggatattggggccgataatttcctgtggctgggacttcttcgaggcaatgtactttggcggaagcatgacagaaggtttcctccggggcatgggcaccttattcggaacctatgcgggtggtttccatggcgaggagaggctgggaaagcttggctatctcgttggaagccagctaggcagctgggttgggggaagaatcggactgatggtctatgatgtcatcaacgggttgaactacatgcttgagtttgtccgtccagaggagtatcgatcatcatcttacgcagcagaagagggctcagagtatgcagataactacagaagttcgtcttacgtatcagaagagggctcagagtatgcagataactacagaagtcgcgaaggatatgagccaacatacagtgagacgccagaagaggcgcaggcggaggaggattcggggggtttcagcttgttctgaaactgcaagcttggatatcagccgacttacaccgggatggtagcaggccagcaagcagcacttgtactgaacttgtttttgcatgtctagatggggaagtgattcttctctgtgattcttgtatggccattgtgtataatagaaacgtttgcatgcaaccacggctctggctgcatggtctaaagagctaaacatgaacaaagaacacatctggagtatcttgtagcatacttggggaacacaggtctctagagtgaatttgctgtatacgtgtctgtcagttcgtttataatttaatttaacataagttgggcaagatgccccttcattt

SEQ ID NO: 376 - DNA, 1776 bp, Zea mays
atggggactcggccgcggggggtcgtcctcgcgccatgggcggtggtgctggtgctggtgctggtgctcgcgcttcgtctggctggcgcgtcgcatgtgatccaccgcagcctggaggccgaggtgccgccgtcggtgccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggaggccgccatctaccccagcatcccgtccgacaagtacggctgctggtcgggctcggcgacgatcctggaggacggcacgccggcgatcctgtacacggggatcgaccggccggacatcaactaccaggtgcaggtgctggcgctccccaaggacgcgtccgacccgctgctccgcgagtgggagaagccggaggagtacaacccggtggcgacgccggcggccggcatcaacgcgacgcagttccgcgacccgacgacggcgtggcggcacgcgggggcggggcactggcggatgctggtgggcagcgtgcgcggcgcgcgcgggatggcgctggtgtaccggagccgggacttcaggacgtggacgaaagccaagcacccgctgcactcggcggcgctgacggggatgtgggagtgccccgacttcttcccggtgtccgggccggggctgcaggccggcctcgacacctcggcgcccggaacaaagtacgtgctcaagagcagcctcgacctcacccgctacgactactacaccatcgggtcgtacgacggcggcaaggaccggtactaccccgacgaccccgccggcgactaccgccgccgcctccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggctgacgtggaggtcagcttcgagctggaggcggggacgagcctgctggagaaggcggaggcgttcgacccggcgtacgacgacgacgcgcagaagctgtgcggcgtcaagggcgcggacgccaggggcggcgtggggccattcggcctctgggtgctggcctccgccgacctgcaggagcggacggccgtcttcttcagggtcttcagggacggacacggcaagcccaaggtgctcatgtgcaccgaccccaccaagtcgtctcttagtccggatctgtacaagccgactctcgcgggtctcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgcccacctctacgttttcaacaacggcgaggtggacgtcacggtgtccggcctgaccgcctgggagatgaagaaaccgctgatgaacggcgcctga

SEQ ID NO: 377 - DNA, 2725 bp, Zea mays
ccttgtccctctcttcctcgaaacgcagctatggggactcggccgcggggggtcgtcctcgcgccatgggcggtggtgctggtgctcgcgcttcgtctggctggcgcgtcgcatgtgatccaccgcagcctggaggccgaggcgccgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccggccggacatcaactaccaggtgcaggtgctggcgctccccaaggacgcgtccgacccgctgctccgcgagtgggagaagccggaggagtacaacccggtggcgacgccggcggccggcatcaacgcgacgcagttccgcgacccgacgacggcgtggcggcacgcggggcactggcggatgctggtgggcagcgtgcgcggcgcgcgcgggatggcgctggtgtaccggagccgggacttcaggacgtggaccaaggccaagcacccgctgcactcggcggcgctgacggggatgtgggagtgccccgacttcttcccggtgtccgggccggggatgcaggccggcctcgacacctccgcgcccggaaggaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggttagtttttatactctagctacgttttgaattccatggatcataaaactgtttttttttacttagtaactagtggcaagctaaggccggcgcccggcggtaacatgtgtgcgtgcgcgcgcacacagctggtcacctgtcaagcttcgattcgcagcttgtcggtagtatacactacactagtactagcagggtatctgtctagccagcccagctgccaagatccaatggtccatgcatgcctgttgtcggcggccgtaaaataatccctgctaggctgctacgttacacacacagccacttgccagcgacaccacggcgcttcgttcgttttctcttctctttcacctctgccgtgcgcgtagtttacgtcgtgcacttgtttctgatttgaagtccggaaacaaacaatgaaacaatcttctgccacacacacacacacacacacacgcacacgtacctgtcgcgtaagaaatcgcggacatgacatgaggaggaggagaatcttccggtgcaatgaaacgcacacgtatgcaagcacgttgttttgatgttgtgatgatggcaggctgacgtggaggtgagcttcgagctggaggcggggacaagcctgctggacaaggcggaggcgttcgacccggcgtacgacgacgacgcgcagaagctgtgcggcgtcaagggcgcggacgccaggggcggcgtggggccattcggcctctgggtgctggcctccgccgacctgcaggagcggacggccgtcttcttcagggtcttcagggacggacacggcaagcccaaggtgctcatgtgcaccgaccccaccaagtcgtctcttagtccggatctgtacaagccgaccttcgcgggcttcgtcgacgccgacatctccagcggcaagattgcccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaggaaaaaaaaactatcatccggccgccacgtgactttctttattttcgttcttcttcttcttcgtcaacacacgtctctgccgccaaaggagaaattgatttatttcaacgtacgtatgtgtacgtctgctgccgaaagagaattgggttattaaaattgtttgaggcaggtccttccattttctcgtccttaattcctctggcaggagtgaccgacgacttgtagtagtttgcttgagcatgttgtttacgctgctagcttcttgttgtacgatacatacatgacgaataaaaaaaatgctgctaattttacagtgtcaacaacaagcaacgagagcgttgctccctcttttctccc

SEQ ID NO: 378 - DNA, 2162 bp, Zea mays
ccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcggggcactggcggatgctggtgggcagcgtgcgcggcgcgcgcgggatggcgctggtgtaccggagccgggacttcaggaagtggaccaaggccaagcacccgctgcactcggcggcgctgacggggatgtgggagtgccccgacttcttcccggtgtccgggccggggctgcaggccggcctcgacacctccgcgcccggaacaaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtcaccgacgacaaggccaagggctgggccggcatccatgcgatcccaaggaagatctggctggaccccaccgggaagcagctgctgcagtggcccatccacgaggtcgagaagcccagggggaaggccgtcagtgtggacgccaagctggtcaagcccggcgaccattttgaggtcacaggcatcgcaacttatcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtgttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaaaaaacaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatatacaacaatatgacacgatgaataaaaaaagtgctgctaattaatttt

SEQ ID NO: 379 - DNA, 3008 bp, Zea mays
  misc_feature (3007)..(3007): n is a, c, g, or t
cctcgaggccggccgggaccgggttggatggagattacatactcgaatagtcagccagccagccggcttgaacgtgcagttttcccctataaaacggccccgacccgtccagtgcccgggcgggccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcggggcactggcggatgctggtgggcagcgtgcgcggcgcgcgcgggatggcgctggtgtaccggagccgggacttcaggaagtggaccaaggccaagcacccgctgcactcggcggcgctgacggggatgtgggagtgccccgacttcttcccggtgtccgggccggggctgcaggccggcctcgacacctccgcgcccggaaggaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggttagttttatactctagctacgttttgaattcsatggatcataaaactgtttttttttacttagtaactagtggcaagctaaggccggcggtaacatgtgtgcgtgcgcacacagctggtcacctgtcaagcttcgattcgcagcttgtcggtagtatacactacactagtactagcagggtatctgtctagccagcccagctgccaagatccaatggtccatgcatgcatgcctgttgtcggcggccgtaaaataatccctgctaggctgctacgtyacacacacacacgccggccattccattccgatgcttgtcttgcccagccacttgccagcgacaccacggcgcttcgttcgttttctcttctctttcacctctgccgtgcgcgtagtttacgtcgtgcacttgtttctgatttgaagtccggaaacaaacaatgaaacaatcttctgccacacacacacacacacacacacgcacacgtacctgtcgcgtaagaaatcgcggacatgacatgaggaggaggagaatcttccggtgcaatgaaacgcacacgtatgcaagcacgttgttttgatgttgtgatgatggcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtcttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaaaaaacaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatacatcaatatgacacgatgaataaaaaaaagtgctgctaattaatttttacagkggkgycaagcaacgagagccagcgctgccctttacgtactarcctcyccyttycgttttgaaactaaaaaaaaaacgtttttarscttttttttttccgcgggaaacanc

SEQ ID NO: 380 - DNA, 2283 bp, Zea mays
cgggaccgggttggatggagattacatactcgaatagtcagccagccagccggcttgaacgtgcagttttcccctataaaacggccccgacccgtccagtgcccgggcgggccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccgggcggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcggggcactggcggatgctggtgggcagcgtgcgcggcgcgcgcgggatggcgctggtgtaccggagccgggacttcaggaagtggaccaaggccaagcacccgctgcactcggcggcgctgacggggatgtgggagtgccccgacttcttcccggtgtccgggccggggctgcaggccggcctcgacacctccgcgcccggaaggaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtgttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaaaaaacaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatatacaacaatatgacacgatgaataaaaaaagtgctgctaattaatttt

SEQ ID NO: 381 - DNA, 2374 bp, Oryza sativa
ggcacatccctttctgcccctcgtcttctccccctccctggccggcctgtctagtacaaaacaatggggactcggctcttggcgctcgcgccatggctgctgctgctcctcctgcagctcgccggcgcgtcccatgtcgtccaccggagcctcgaggccgagcaggcgccgagctcggtgccggcctccattgtcagccccctgctcaggacaggataccacttccagcccccgatgaactggatcaacgatccgaacgggccactgtattacaagggatggtaccacctattctaccagtacaaccccaagggagctgtgtggggcaatatcgtgtgggctcactcggtatcacaggacctcatcaactggatagcccttgagccggcaatcaagcccgacatcccctccgaccagtacggttgttggtctggctctgccaccatccttcccgatggcacgccggcgatcctctacactgggatcgaccgccccaacatcaactaccaggtgcagaatatcgcatttcccaagaatgcgtcagacccgctccttcgtgagtgggtcaagccggcctacaacccggtggccacgccggagcctggtatgaacgcaacgcaattccgcgatccgacaacggcctggtacgccgacggtcattggcggatgctcgttggtggcctgaagggggctcgcctcggccttgcctacctctaccggagccgggacttcaagacatgggttcgggccaagcacccactccattcggcgctcactgggatgtgggagtgcccagacttctttccgttgcaagcaccaggtctccaggctggcctcgacacatctgtgccgagcagcaagtacgtgctcaagaacagcctcgatctcacccgttatgactactacacggtgggcatctacaacaaggtgacggagcggtatgtgccggacaaccctgctggcgactaccaccggctccgctatgactacggcaacttctacgcatcaaagaccttcttcgacccggtgaagcaccgccgcatcctgcttgggtgggctaacgagtccgacagcgtcacctacgacaaggcgaagggctgggccggcatccatgtaaattatagttacaattttgcaatcctaatttcttgtactacctacctccacaaatgtttgatgttattagttatcttaatttcaagagctaaccaaacgtaaaagaaaaattggagggactagaggtttaattagaattgatttggagattgatggcttggcttgtgtcgttggcaggcgatcccaagaaaggtatggctggacccgagcgggaagcagcttctgcagtggccaatcgaggagctggagacgctgaggggcaaatcggtcagcgtctttgacaaggtggtgaagcccggggaacatttccaagtcacgggcctcggaacctaccaggctgacgtggaggtgagcttggaggtgtccgggctggagaaggcggaggcgttggacccggcgttcggcgacgacgcggagaggctgtgcggcgcgaagggcgcggacgtgaggggcggcgtggtgttcgggctgtgggtgctggcctccgccggcctggaggagaaaaccgccgtcttcttccgcgtcttcaagccggccgggcacggcgccaagcccgtcgtcctcatgtgcaccgaccctaccaagtcttctcttagcccggatctctacaagccaacttttgccgggttcgtcgacaccgacatctcgtccgggaagatctccttgagaagcttgattgaccgttcggtggttgagagcttcggcgccgggggcaagacctgcatcctgtcgagagtttacccgtcgatggcgataggtgacaaggcccatctttacgtcttcaacaatggggaggcggatattaagatttcacatctgaaagcgtgggaaatgaagaagccgcttatgaatggcgcctaattaatttgccgcggatatatatgatggcgactttaattaattgctattattaaatcatcactcgccatctgcgatataccggccagatcgtccctgacatcgatctcctgttcttggccgatgttgcacgctgcacgatatttgattgcttgttgctgaggatgattggagtttgtattcgtgtctccagatatcgaaagaccagggtaattttacactcttcttgtacaattaattgattgtatcacgagttgtttgtaaacaattgtttgtatcacgagttgtttgcaaacatttgtttgtaccacgatcgagttgtgtgacaaataaattaagatgctgattatttcatcatgttacagataataaagaggttttccgtgatttacttcacttg

SEQ ID NO: 382 - DNA, 2193 bp, Oryza sativa
gacacatccctttctgcccctcgtcttctccccctccctggccggcctgtctagtacaaaacaatggggactcggctcttggcgctcgcgccatggctgctgctgctcctcctgcagctcgccggcgcgtcccatgtcgtccaccggagcctcgaggccgagcaggcgccgagctcggtgccggcctccattgtcagccccctgctcaggacaggataccacttccagcccccgatgaactggatcaacgatccgaacgggccactgtattacaagggatggtaccacctattctaccagtacaaccccaagggagctgtgtggggcaatatcgtgtgggctcactcggtatcacaggacctcatcaactggatagcccttgagccggcaatcaagcccgacatcccctccgaccagtacggttgttggtctggctctgccaccatccttcccgatggcacgccggcgatcctctacactgggatcgaccgccccaacatcaactaccaggtgcagaatatcgcatttcccaagaatgcgtcagacccgctccttcgtgagtgggtcaagccggcctacaacccggtggccacgccggagcctggtatgaacgcaacgcaattccgcgatccgacaacggcctggtacgccgacggtcattggcggatgctcgttggtggcctgaagggggctcgcctcggccttgcctacctctaccggagccgggacttcaagacatgggttcgggccaagcacccactccattcggcgctcactgggatgtgggagtgcccagacttctttccgttgcaagcaccaggtctccaggctggcctcgacacatctgtgccgagcagcaagtacgtgctcaagaacagcctcgatctcacccgttatgactactacacggtgggcatctacaacaaggtgacggagcggtatgtgccggacaaccctgctggcgactaccaccggctccgctatgactacggcaacttctacgcatcaaagaccttcttcgacccggtgaagcaccgccgcatcctgcttgggtgggctaacgagtccgacagcgtcacctacgacaaggcgaagggctgggccggcatccatgcgatcccaagaaaggtatggctggacccgagcgggaagcagcttctgcagtggccaatcgaggagctggagacgctgaggggcaaatcggtcagcgtctttgacaaggtggtgaagcccggggaacatttccaagtcacgggcctcggaacctaccaggctgacgtggaggtgagcttggaggtgtccgggctggagaaggcggaggcgttggacccggcgttcggcgacgacgcggagaggctgtgcggcgcgaagggcgcggacgtgaggggcggcgtggtgttcgggctgtgggtgctggcctccgccggcctggaggagaaaaccgccgtcttcttccgcgtcttcaagccggccgggcacggcgccaagcccgtcgtcctcatgtgcaccgaccctaccaagtcttctcttagcccggatctctacaagccaacttttgccgggttcgtcgacaccgacatctcgtccgggaagatctccttgagaagcttgattgaccgttcggtggttgagagcttcggcgccgggggcaagacctgcatcctgtcgagagtttacccgtcgatggcgataggtgacaaggcccatctttacgtcttcaacaatggggaggcggatattaagatttcacatctgaaagcgtgggaaatgaagaagccgcttatgaatggcgcctaattaatttgccgcggatatatatgatggcgactttaattaattgctattattaaatcatcactcgccatctgcgatataccggccagatcgtccctgacatcgatctcctgttcttggccgatgttgcacgctgcacgatatttgattgcttgttgctgaggatgattggagtttgtattcgtgtctccagatatcgaaagaccagggtaattttacactcttcttgtacaattaattgattgtatcacgagttgtttgtaaacaattgtttgtatcacgagttgtttgcaaacatttgtttgtaccacgatcgagttgtgtgacaaataaattaagatgctgattatttcatcatgttacagataataaagaggttttccgtgattttttaaaagg

SEQ ID NO: 383 - DNA, 2376 bp, Sorghum bicolor
accatttcccccatccaaaccgtcccttacccttcttgttcctcttccgcctaccgcaatggggactcggcaacgggtcctccatttcccccatccaaaccgtcccttacccttcttgttcctcttcctcgaaacgcaatggggactcggcaacgggtcctcgcgccatgggcggtgctgctgctcaccgcgctgcagctcgccggtgcctcccatgttgtcgtccaccggagcctggaggccgaggcggcggcggcaccgccgtcggtgccggcctccattgtcagccccctgctcaggacagggtaccatttccagccaccaatgaactggatcaacgaccccaacgctccgatgtactacaagggatggtatcacctgttctaccagtacaaccccaagggcgcagtatggggcaacatcgtgtgggctcactccatatcacgcgacctcatcaactggatcgcgctggagcccgccatctacccgagcatcccctccgaccagtacggctgctggtcgggctcggcgacgatgctgcaagacggcacgccggcgatcctctacactgggatcaaccgcccggacatcaactaccaggtgcaggtgctcgccttccccaagaacgcgtcggacccgctgctccgggagtgggagaagccggcggcgtacaacccggtggcggcgccggtgggcggcatcaacgcgacgcagttccgcgacccgacgacggcgtggtacgccgacgggcactggcggatgctggtgggcagcgtgcgggacacccggggcatggcgatcgtgtaccggagccgggacttccggcgctggacgaaagccaagcacccgctgcactcggcgctgacggggatgtgggagtgcccggacttcttcccggtgtccggcccggcgctccaggasggggtcgacacctccgacgccggcgccaagtacgtgctcargaacagcctcgacctcacgcggtacgactactacaccatcgggtcgtatgataagaggaaggaccggtactacccggataatccgaacggcgactaccaccggctccggtacgactacggcaacttctacgcgtccaagacgttctatgatccggcgaagcggcggcgggtgctcctcgggtgggctaacgagtccgacagcgtccccgacgacaaggccaagggatgggccggcatccatgcgatcccaaggaagatctggctggatcccagcgggaagcagctgctgcagtggcccatcgaggaggtcgagaagctcagagggaaggccgtcactgtgggcggcaaggtggtgaagcccggcgagcattttgaggtcacaggcatcgcaacttaccaggctgatgtggaggtgagcttcgagatctcgagcttggacaaggcggagcccttcgacccggcgtacgacaacgacgcgcagaagctgtgcggcgtcaagggcgccgacgtcaagggcggcgtagggcccttcggcctgtgggtgttggcctctgccgacctgcaggagaagacggccgtcttcttcagagtcttcaaggacggctacggcaagcccaaggtgctcatgtgcaccgaccccaccaagtcatcgcttagtccagatctgtacaagccgaccttcgccggcttcgtcgacactgacatttcaagcgggaagattgctcttagaagcttggtacgtacagactaatgtcacaattattgttgactactgctgctaattaagcaattggagattacgacttatcacttgactgatcttatattattatatcttgttgctgctgtttgttgtttccttgtgcgacatggcatctgctatgtgctacagatcgatcggtccgtggtcgagagcttcggcgaaaaaggaaggacttgcatcctgtcacgggtctacccgtccatcgccattggaaaggaggctcacctctacgttttcaacaacggtgacgtggacgtcaaggtgtcaagcctgacagcatgggagatgaagaagccgctgatgaacggcgcctaatagaagcgtgaatgacttgattcgtttttcttcaacgacgaccgtaccattgctgccagaaatactactattgattattattagttaattagttaattgttgaggtccttcagttttcgcccttcatcatctacacaagtgacgactagtagtttgagttggtttacttccattggctggatgattcttcttcttcttcttatgtgtgtacacacacggatgggagtataggcattacgtgctcagctgtccggcaaagagaaattgattacgcttcttcttcttgtattgtacaataatatgagatgaataaaaggctgctaatttacagtgtcc

SEQ ID NO: 384 - DNA, 2101 bp, Saccharum officinarum
tccaaaaccgtccccctcttcctgctgccgcatcctcagaaacgcaatggggactcggcagcgggtcctcgcgccatgggcggtgctgctgctcgcgctgcaggtcgccggtgcctcccatgtcatccaccggagcctggaggccgaggcggcaccgccgtcggtgcctgcctccattgtcagccccctgctcaggacggggtaccatttccagccgccaatgaactggatcaacgaccccaacgctccgatgtactacaagggatggtatcacttgttctaccagtacaaccccaagggcgcagtatggggcaacatcgtctgggcacactccgtgtcacgcgacctcatcaactggatcgcgctggatcccgccatctacccgagcatcccgtccgaccagtacggctgctggtcgggctcggcgacgatgctgaaagacggcacgccggcgatcctgtacacggggatcaaccgccccgacatcaactaccaggtgcaggtgctcgcgttccccaagaacgcgtcggacccgctgctccgggagtgggagaagcccgcggcgtacaacccggtggcggcgccggtgggcggcatcaacgcgacgcagttccgcgacccgaccacggcgtggtacgcggacgggcactggcggatgctggtgggcagcgtgcgggacacccggggcatggcgctcgtgtaccggagccgggacttcaggacgtggaggaaggccaagcacccgctgcacttcgcgctgacggggatgtgtggagtgcccggacttctttccggtgtccgggccggcgctcgaggacgggctcgacaccttcgacgccggggccaaagtacgtgctcaagagcagcctggacctcacacggtatgactactacaccatcgggtcgtaccaaaggaggaaggaccggtactacccggataacccgaacggtgactaccaccggctgcggtacaactacggcaacttctacgcgtccaagacgttctacgacccggcgaatcggcggcgggtgctgctcgggtgggctaacaagtcggacagcgtgcctgacgacaaggccaagggctgggccggcatccatgcgatcccaaggaagatctggctcgaccccagcgggaagcagctgctgcagtggcccatcgaggaggttgagaagctcagaggaaagcccgtcagtgtgggcagcaagctagtcaagcccggcgagcattttgaggtcacaggcgtcgcgacctaccaggctgatgtggaggtgaccttcgaggtctccagcttggagaaggcggaggcgttcgacccggcgtacggcaacgacgcgcagaagctgtgcggcgtcaagggtgcggacgtcaagggcggggtggggcccttcggcctgtgggtgctggcctctgccgacctgcaggagaagacggccgtcttcttcagagtcttcaaggacggatacggcaagcccaaggtgctcatgtgcaccgaccccacaaagtcctctcttagtccagatctgtacaagccaaccttcgcgggcttcgtcgacactgacatttcaagcgggaagattgctcttagaagcttgatcgatcggtccgtggtggagagcttcggcgcgggaggcaagacgtgcatcctgtcacgggtctacccgtccatcgccgttggaaaggatgctcacctctacgttttcaacaacggtgaggtggacgtcaaagtgtcaagcctgactgcctgggagatgaagaaaccgctcatgaacggcgcctaatagacgcgtgaatgactttattcgtttcctcttcaacgaccgtacctttgctgccagaaatattattgattattgattgttgaggtccttcagttttcgcccttcatcatctacacaagtgacgactagtagtttgagttgttttacttccattggctggatattcttcttctagtgtgtgtaaaacacaaatgggagtatataggcaggctttacgtgctcagctgtccgccaaagagagaaattgattacgcttcttcttgattgtacaataatatgagatgaataaaaaggctgctaattttacaaaaaaaaaaaa

SEQ ID NO: 385 - DNA, 2078 bp, Zea mays
  misc_feature (631)..(635): n is a, c, g, or t
  misc_feature (1015)..(1019): n is a, c, g, or t
tacaaataacaccgatcagtacttggttctcttctcctgtgctccacattataatactgtttgatcagtcctaattggtttcagaaaagctatctcgtactagtgagttagggacgacgatgggcatggcggcgctgttgcttgtgtgggctctgctgcactgcgcaggcacggtgacgatggtgcgggcgtcccacgccgtgtatccggagctccagtcactggaggcggagaaggttgatgagacgtcgcgcaccgggtaccatttccagcctccaaagcactggatcaacgatccaaatggaccaatgtactacaaggggctgtaccacctgttctaccagtacaaccccaagggcgcggtgtggggcaacatcgtgtgggcgcactcggtgtcgaccgacctgatcgactggacggcgctggccccggggatctacccgtcgaggcagttcgacgtgaagggctgctggtcgggctccgcgacggtgctgccgagcggagtgccggtggtgatgtacacgggcatcgacccggacgagcaccaggtgcagaacgtggcgtaccccaagaacctgtcggacccgttcctccgcgagtgggtgaagcccgactacaaccccatcatcgnnnnngacagcggcgtgaacgccagcgccttccgcgacccgaccaccgcctggtacgggcccgaccgccactggcgcctgctggtgggcagcaaggtgggcggcaagggcctggccgtgctgtaccggagccgggacttcaggcgctgggtcaaggcgcaccacccgctccactccggcctcacggggatgtgggagtgcccggacttcttccccgtcgcggtgcacggcggcggccgccactaccgccgcggcgtcgacaccgccgagctgcacgacagggccctggccgaggaggtcaagtacgtgctcaaggtcagcctggacctcacgcgctacgagtactacacggtgggcacctacgaccacgccacggaccgctacannnnngacgccggcttccgcgacaacgactacggcctgcgctacgactacggagacttctacgcgtccaagtccttctacgatccggccaagcgccgccgcgtgctgtggggctgggccaacgagtcggacaccgttcctgatgaccgcaggaagggctgggccgggattcaggcgataccgaggaagctgtggctgtccccacgcgtccggcagctgatccagtggccggtggaggaggtcaaggctctgcgcgccaagcacgtgaacgtcagtgacaaggtcgtcaagagcgggcagtacttcgaggtcaccggcttcaagtccgtgcagtccgacgtggaggtggagttcgcgatcggcgacctaagcaaggcggagcggttcaaccccaggtggctgaccgacccgcaggcgctgtgcaagaagcggggcgcccgggagacgggcgaggtggggccgttcgggctgtgggtgctggccgctggcgacctcacggagaggacggccgtcttcttcagggtgttccgggccaacagcagcagcagcagcaggctcgtcgtcctcatgtgcaacgaccctactaactccaccttcgaggcgcaggtctacaggcccaccttcgccagcttcgtcaacgtcgacatcgccagaaccaagacgatcgcgctgaggacactgatcgaaccctccgtggtggagagcttcggcgcgggcggcaggacgtgcatcctgacgagggtgtaccccaagaaggccctgggcgacaacgcgcacctcttcgtcttcaaccacggcgaggtggacgtcaaggtcaccaggctggacgcctgggagatgaggaccccgaagatgaacgtgccggcgcagtagctagtggtggtagtggtagctcgatctagggaaatggtctagttttgttagagaagcggttctggctcgttttcgctcacgtcgcctctcagattgttctcgatctcatccatcactacattgcaacgaattctaccactctctcggcgcctcccactggtttagcaatgaataaaaattacaggtacaggg

SEQ ID NO: 386 - DNA, 2289 bp, Oryza sativa
twttgatcatccgagtcctaactgggtctcactaagcgaggtaagtagtgtgttagtggaaatggcgacggcgagggcgagggccgcgctggtgtttgtggctctgctgcagatggcggcagtggtggtggtgcgcgcgtcgcacgtcgtctacccggagctccagtcgctggaggcgaagcacgtcgacgggaagctccggaccgggtaccacttccaaccacccaagcactggatcaacgatccgaacggtccgatgtactataagggcttgtaccatctgttctaccagtacaaccccaagggcgccgtgtgggggaacatcgagtgggcgcactcggtttcgacggacctgatcgactggacggcgctggagccggggatctacccgtccaagacgttcgacgagaagggctgctggtcgggctccgccaccgtgctccccagcggcgtgccggtgatcatgtacaccggcatcgaccccgacgagcggcaggtccagaacgtcgcctacccggtgaacctctccgacccgtacctccgcgagtggtacaagcccgactacaaccccatcatcaacccggacggcggcatcaacgccagcgcgttccgcgacccgaccaccgcctggtacgggcccgacggccactggcggctcctcgtcggcagcaaggtgaacatgaaggggctcgccgtgctgtaccggagccgggacttcaagaagtgggtcaaggcgcaccacccgctgcactcggcgcacaccgggatgtgggagtgcccggacttcttccccgtcgctgtggcgggcgggagccgccactaccgccgcggcgtcgacaccgccgagctgcacgacgccgccgtggcggaggaggtcaagtacgtgctcaaggtgagcctcgacctgacgcggtacgagtactacaccgtcggctggtacgaccacgccaccgaccggtacgtccccgacgccgccttccccgacaacgactacggcctccgctacgactacggcgacttctacgcatccaagtcgttctacgacccggccaagcgccgccgcatcgtctggggctgggccaacgagtccgacaccgtacccgacgaccgccgaaagggctgggccggcatccaggcgataccgaggaagctctggctgtcggcggacgggaagcagctggtgcagtggccggtggaggagctcaaggcgctgcgagccaagcacgtcaatgtcactgacaaggtcatcaagaagggcaactacttcgaggtcaccggcttcaagtccgtgcagtcggatgtggatatggcgttcgcgatcaaggacctgagcaaggcggaggagttcgacccggcgtggcggacggacgcggaggcgctgtgcaagaagctcggctcggacgtcgacggcggcgtggggccgttcgggctgtgggcgctggcctccggcgacctcaaggagaggacggccgtcttcttcagggtgttcaaggccaacgactcctcgcacgtcgtcctcatgtgcaacgaccctaccaggtcatcgtacgagtcgaagatctacaggccgaccttcgccggcttcgtcgacgtcgacatcgccaagaacaaacaaatcgccctccggacattgatcgatcactccgtggtggagagcttcggggcgcgcggcaagacgtgcatcctgacgagggtgtacccgaggaaagccgtcggcgacgacgcgcacctcttcgtcttcaacaacggcgagtcggacgtcaaggtcaccaacctggacgcctgggagatgaagaccccgaagatgaacgcggaggagtagcagcagtagcaagcagcacatcagcctagacatggtggttgtagcagtactggtagagtagccgcctagccgggcgtttagctagctactctctccgtcccaaaataagtccagttttaacactgttcatgtccaacatttgaccgttcgtcttatttgaaaaaagattatgattagtatttttattgttattagatgataaaacatgaatagtactttatgtgtgactaatttttaaatattttttataaatttttcaaacagacggatggtcaaaacgctgagtacgcatatctatggctgcacttattttgggacggaggtagtagatactagcttctttagctgagattttgggataaatttggaggctgcagtgtagtgttttgatgcattgttagggaaagaaatggtctgttttgtatcataattgttgcactcaatgcgtgaagaaagtattgctggcc

SEQ ID NO: 387 - DNA, 2289 bp, Oryza sativa
ttttgatcatccgagtcctaactgggtctcactaagcgaggtaagtagtgtgttagtggaaatggcgacggcgagggcgagggccgcgctggtgtttgtggctctgctgcagatggcggcagtggtggtggtgcgcgcgtcgcacgtcgtctacccggagctccagtcgctggaggcgaagcacgtcgacgggaagctccggaccgggtaccacttccaaccacccaagcactggatcaacgatccgaacggtccgatgtactataagggcttgtaccatctgttctaccagtacaaccccaagggcgccgtgtgggggaacatcgagtgggcgcactcggtttcgacggacctgatcgactggacggcgctggagccggggatctacccgtccaagacgttcgacgagaagggctgctggtcgggctccgccaccgtgctccccagcggcgtgccggtgatcatgtacaccggcatcgaccccgacgagcggcaggtccagaacgtcgcctacccggtgaacctctccgacccgtacctccgcgagtggtacaagcccgactacaaccccatcatcaacccggacggcggcatcaacgccagcgcgttccgcgacccgaccaccgcctggtacgggcccgacggccactggcggctcctcgtcggcagcaaggtgaacatgaaggggctcgccgtgctgtaccggagccgggacttcaagaagtgggtcaaggcgcaccacccgctgcactcggcgcacaccgggatgtgggagtgcccggacttcttccccgtcgctgtggcgggcgggagccgccactaccgccgcggcgtcgacaccgccgagctgcacgacgccgccgtggcggaggaggtcaagtacgtgctcaaggtgagcctcgacctgacgcggtacgagtactacaccgtcggctggtacgaccacgccaccgaccggtacgtccccgacgccgccttccccgacaacgactacggcctccgctacgactacggcgacttctacgcatccaagtcgttctacgacccggccaagcgccgccgcatcgtctggggctgggccaacgagtccgacaccgtacccgacgaccgccgaaagggctgggccggcatccaggcgataccgaggaagctctggctgtcggcggacgggaagcagctggtgcagtggccggtggaggagctcaaggcgctgcgagccaagcacgtcaatgtcactgacaaggtcatcaagaagggcaactacttcgaggtcaccggcttcaagtccgtgcagtcggatgtggatatggcgttcgcgatcaaggacctgagcaaggcggaggagttcgacccggcgtggcggacggacgcggaggcgctgtgcaagaagctcggctcggacgtcgacggcggcgtggggccgttcgggctgtgggcgctggcctccggcgacctcaaggagaggacggccgtcttcttcagggtgttcaaggccaacgactcctcgcacgtcgtcctcatgtgcaacgaccctaccaggtcatcgtacgagtcgaagatctacaggccgaccttcgccggcttcgtcgacgtcgacatcgccaagaacaaacaaatcgccctccggacattgatcgatcactccgtggtggagagcttcggggcgcgcggcaagacgtgcatcctgacgagggtgtacccgaggaaagccgtcggcgacgacgcgcacctcttcgtcttcaacaacggcgagtcggacgtcaaggtcaccaacctggacgcctgggagatgaagaccccgaagatgaacgcggaggagtagcagcagtagcaagcagcacatcagcctagacatggtggttgtagcagtactggtagagtagccgcctagccgggcgtttagctagctactctctccgtcccaaaataagtccagttttaacactgttcatgtccaacatttgaccgttcgtcttatttgaaaaaagattatgattagtatttttattgttattagatgataaaacatgaatagtactttatgtgtgactaatttttaaatattttttataaatttttcaaacagacggatggtcaaaacgctgagtacgcatatctatggctgcacttattttgggacggaggtagtagatactagcttctttagctgagattttgggataaatttggaggctgcagtgtagtgttttgatgcattgttagggaaagaaatggtctgttttgtatcataattgttgcactcaatgcgtgaagaaagtattgctggcc

SEQ ID NO: 388 - DNA, 2033 bp, Triticum sp.
ggcacgagaatccatccacccgtcctcctccgcgacgcaagatcggccgatccaatccagtaacgaagatggcgtcggcggcggcgccattgatcgtgtctctgttgtgctgcacggcgttggcggtccacgcgtcgcatgtcgtctacccggagctccagtcgttggaggccacggaggtggacaaggagctgcgcaccgggtaccacttccagccccccaagcattggatcaatgatccaaatgggccgatgtactacaaggggctgtaccatctcttctaccagtacaacccaaagggcgccgtgtgggggaacatcatctgggcgcactcggtgtcgacggacctcgtcgactgggtggcgttggagcccgggatctacccgtccaagccgttcgacatcaacggttgctggtcgggctccgccaccattctgcccaacggcgtcccggtcatcatgtacacaggcatcgaccccaaggaacgccaggtgcagaacgtcgcgtacccggccaacctctccgaccccttcctccgcaagtgggtcaagcccgactataaccccatcatcaaccccgaccacggcatcaacgccagcgccttccgtgatcccaccaccgcttggtacgggccagacggacactggaggctggtggtgggcagcaaggagaacatgagggggatcgcggtgttgtaccggagccgtgactttaggagatggatcaaggcacaccactcgctgcacgctgggctcacggggatgtgggagtgcccagacttttaccccgtggcggtggccggcggcagacgtcaccaccggagcggtgtggacaccagagagctgcatgacagcacagtcgctgcggaggtaaaatatgtgctcaaggtgagcctcgacgtaacgcgctacgagtactacaccattggctggtacgaccatgccaaggacaggtacaccccggacctcgacttcccagacaatgactacggtctccgatacgactacggcgacttctatgcatcgaagtcgttctatgacccggtcaagaagcgccgcgtgctctggggctgggccaatgaatccgacactgtccccgacgaccgcaacaagggttgggccggcatccaggcgataccgaggaagatcttcctgtcacggagcgggaggcagctaattcagtggccggtagaggagatcaagtcattgcgcgcgaagcacgtcaatgtcagcaacaaggccgtcaagggtggcgagtacttcaagatcgacggcttcaaatccgtgcagtcggacgtggaggcggcgttcgtgatcaagaaccttgagaaggcagagaagttcgacaccgcgtggcagacagacgcgcaagggctgtgcaagaagctcaactcacatgttaagggcggcgtcgggccgtttggtctctggttgctcgcctctgacgacctcaaggagagaacagctgttttcttcagggtattcaagaacaacgacactagctacgtcgtgcttatgtgcaacgaccctacaaggtcgtcgtacgagtcgctgatctacaggccgaccttcgccggcttcgtcaacgtcgacataaccaagaccaagaagatcgccctcaggacattgatcgaccactctgtcgtggaaagttttggcgccggcggcaagacgtgcatcctgacgagggtctacccgaggaaggccgtcggggacaacgcacacctatttgtcttcaacaatggcgagtcagacatcaagctcaccaacctgcgtgcatgggagatgaagacccccacgatgaacaagcgtctggggcagtagtagcaacagagcccggcctagtagatcgaagattcagagtagcctagactagccatagctagctagcttgttgatttagttgagattaattaggataggctccaggtttagtgatgagttgttagaaatgcaggaaatggtccgttttgtttcagaacctttttcaaatggcaggaggccttgaaaagccaacatatcaacaaaatttcg

SEQ ID NO: 389 - DNA, 1906 bp, Zea mays
tttccacgcgtccgcgcgtcgcgccccctgccattaaggccagatcctagcccgccattaatgccgctactagcccgagctccacgagatcagagaggcggcggctgggctgaggccccgtgttcgcgccaggccaggcgtggccaccgtgacacgcgccgacgccgtttataaaagcgcaccgacgccgtccgccctcgcctggggttctgcatgctctgcgcctcactctatgtcaccgcgcgtccgtgtccgtcaccagaccttggcggccgcgtagcgtaggatgctcacgtgcatcgcgtgctccaagcagcagttctccggcggcggcccgccactgcacgagccgccggaggacgacgatgtcgttggtggaggcgccggcaccagcgccggcgcggcgacgccgagcacacggcacgccatcaaggcgctcaccgcccagatcaaggacatggcgctcaaggcgtcgggcgcgtaccggcaatgcaagccctgcgcgggctcctcggcggcggcctcgcggcggcaccacccgtaccaccaccgcggcggcagcgccttcgggggctccgacgccgactcgggggcctccgaccgcttccactacgcgtaccgccgcgcggggagctcggcggcctcgactccgcgattgcgcagcggaggcgccgccctgtcgagtggcgacgccacgccctccatcagcgtgcgcaccggcaccgacttccccgccggcgatgacgacgacgacgagatgacgccagaagccactggcggatgtggtggcaaggacgacgacgccaaggagtgggtggcgcaggtggagcccggtgtgctcatcactttcgtctcactggcggaaggtggcaacgacctaaaacgcattcgattcagccgtgagatgttcaacaaatgggaagcacaaagatggtgggctgaaaactatgacaaagttatggaactttacaatgtgcagaagtttaatcaaactgtccctctcccagctaccccaaaatctgaagatgagagctccaaggaggacagcccggtgacaccaccactggacaaggaaaggctaccccgcactttccacagacaaggtggtggagcgatgggctcctcttcatcagattctctcgagcatcactcaaaccactactgtactggccgccaccaccaccaccaccaccatggacaccaatgctgtgattcaatgggcctggcatcaacgccaaagctgtcaagtatcagtggagccaaaacagaaacctcatcgatggacgcgtcaatgaggacaagctcgtcacctgaggagatcgacaggtctggtgagctctcggtgtccgtcagcaatgcgagcgaccaggagagggagtgggtcgaagaagacgagccaggcgtatatatcacaatccgggctttacctggtgggatcagagagcttcgccgcgttcggttcagccgggagaagttcagcgagatgcatgccaggctgtggtgggaagagaaccgagcgaggatacacgaacaatacctctgagaagagacgcccgacaccatcagcagcacgagcacatgaatagagctggcactaacacatccacatgcatttccagcttcatacgatgttttgctaacctaagaggtccggtttccggtattttacatttcgttcagtctcacgtgtggtggtggtggggtgggaggatagtgtacgtatttcacagtttcactactgaatctgtaggtctcgtttttcatcaataatgtatatctacctgttgtttcccataagacaaattagcatgcttgtgtttgtgttgtgtgcgctactttgctcttgtcactgtcttattgtactcgaactcttccagacataacaataatcaacccccaagtkggc

SEQ ID NO: 390 - DNA, 1994 bp, Oryza sativa
cagcagtaacgtctgtgagcagccgctgcgccgctcataaataaaccccccccccccccccccccaattgtgctcctccgcctcttcctgccattaagcaccagatcctaatccgccattaatgcccttaactccaagctcgatatcagaggaggaagaagaggcgtaggagtagtacggctccgccgcctccctcccctgccattataagctcacgcgcggcgctcgcccgggcggctctgccacctgtgaccttgctgttgctgtcaccggagaggcggaggggatgctcacgtgcatcgcgtgctcgaagcagcccggcggcggcggcggggagccgctgcacgagccgccggaggacgaggacgccgtcgatggcggcggcggcggcggcggggcgacgcccagcacgcggctggccatcaaggcgctcactgcgcaggtggggttctcgatcaaggacattgcgttgaaggcgtcgggcgcgtaccggcactgcaagccctgcgccggctcgtcgtcggcggcgggggcctcgcgccggcaccacccgtaccaccaccgcggcggcggcggcggcttcggcgaccccgacgcggcctcgggctccgaccggttccactacgcgtaccgccgcgccacgagctcggcggcctcgacgccgcgcttccgcggcggcggcggcggcggcgcgctgtcgagcggggacgctacgccgtccatgagcgcccgctccgacttccccatcggcgacgaggaggatgaggaggaagacgacgacgacgagatggtgtcaaccggcggcggcggcggcggcaaggaggaggacgcgaaggagtgggtggcgcaggtggagcccggcgtgctgataaccttcgtctcgctgccacagggcggcaacgacctcaaacgcatccggttcagccgtgagatgttcaacaagtggcaagcacaaagatggtgggctgaaaattatgacaaagttatggagctttacaatgtacagagatttaaccatcaagctgttcctcttcctgctactccaaaatctgaagacgagagctcaaaggaggacagcccggtgacaccaccactggggaaggaacggttacctcgttcgttccatagaccattgtcaggtggtggtgcagtgggttcatcttcatcagattctcttgagcatcattcaaaccactactgtaatggtggccaccaccaccatggacaccagtgctatgattcagtggggctggtctcaacaccgaagctgtcaagtataagtggagccaagacagaaacctcgtcaatggacgcatcaatgaggacgagctcatctcctgaagaggtcgacagatctggtgagctctcggtgtccatcagcaatgcaagtgaccaagagcgggagtgggtcgaggaagacgagcctggtgtatatattaccatccgggctttgcctggtggtatcagagaactccggcgtgttcgattcagccgagagaggttcagcgagatgcatgccaggctatggtgggaagaaaaccgagcgaggatacatgaacagtatctctgagatgaaaaaaagaacttgtcctcgcgacacacacaagtggttcttcaacgaacaatgaatccagagttgtacatttggcactaacagtacgccctttgcgggcagcagcagccgtctcagttgatactgattgtgcatgcatgtgagcttaattttaaagctttgttactactaaccttaggctcttgttgtggcaaattcacatgttctttttcatggttttggcttttgctttggacaggaagcttttgttgaggaactcaagactatcgtagagtgattagcctagaaaaataataattagaaattccatattccctgaacctgtagtttgcaaaaccaaaagtgtttcttccaagttccatacaccagtacttggtatttttttctcttcatcagtaaattgaaattggtttttgtccca

SEQ ID NO: 391 - DNA, 1521 bp, Hordeum vulgare
tcggcacgaggccggtccccaccatccccggtttcccctcgaacgcccacctctgcttccacctccacatcaagctccagttcgtccgcgccggaactagtgcgatcgagcgagtttccccggcccataccgatggctctggtcccctcgggctcaggcagcgcgccagtgattgccgaggtggagatgaacggcggcgcagaccagagcgccgccaccgtacgagccaccgtcgtgcaggcctccaccgtcttctacgacacccccgccactctcgataaagcagagagactgatagcagaggctgctggatatggttcacagttggtcgtgttcccggaagcttttgttggtggttatcctcgtggatccacctttggctttgggatcagtattagtatcactaatccaaaagacaagggaaagggtgaattccagaagtattatgcagctgccatagacgtgcctggtccagaggtcacacgcttagctgctatggctgggaaatataaggtctttctggtaatgggagtgattgagagagaaggttacacactgtattgttcagtgctcttctttgaccctctaggtcggtacctgggtaagcaccgcaagctcatgccgacggcattagaaaggataatatggggatttggagatggatcaacaattcctgtttatgacactccacttggaaaaattggagctcttatttgctgggaaaataagatgccactgttaaagacagcacctgtatggccaaaggtattgagatatattgcgctcccacggctgattcgaagccagtctggcaagcttccatgacacacatcgccatggaggggggatgctttgtgttgtcggcgaaccagttctgccgcagaaaggactaccctccgccatccgagtacgcctttgccggtttaggagaagagccgtctccagacaccgttgtttgccctggaggcagtgttatcatttcgccgtcaggggaagtcctggcaggtcccaactacgacggagaggcgctgatcacagccgaccttgacatgggagagatcgttcgggccaagtttgatttcgacgtggtgggccactacgctcggcctgaggtgctgggcttggtggtggacgaccagccgcaccgtccggtgtccttcacctctgccgctgagaaggccccggctgccaagagcgacggcgccgcaaagccctgaccgcctgacgaccatcagctcagtcacaaagcagttgattgataactatcgatagttctctttttgtgtgatgaaaggacttctgttggtagcttaataaggcgatgaaatgtgggctcggatcgcccgcatgtctgacgcccctgtaactttcgctgcttgtaaagtgcattcccgaacaatcagctgaggtccgttcaccatgggcgtgttgggttgcccgggtggctctagcctgcatcgcatgggggatcctgggtgagcgtggcctggttgaggtgatacagagatgagctaagatgtg

SEQ ID NO: 392 - DNA, 1519 bp, Hordeum vulgare
tcggcacgaggccggtccccaccatccccggtttcccctcgaacgcccacctctgcttccacctccacatcaagctccagttcgtccgcgccggaactagtgcgatcgagcgagtttccccggcccataccgatggctctggtcccctcgggctcaggcagcgcgccagtgattgccgaggtggagatgaacggcggcgcagaccagagcgccgccaccgtacgagccaccgtcgtgcaggcctccaccgtcttctacgacacccccgccactctcgataaagcagagagactgatagcagaggctgctggatatggttcacagttggtcgtgttcccggaagcttttgttggtggttatcctcgtggatccacctttggctttgggatcagtattagtatcactaatccaaaagacaagggaaagggtgaattccagaagtattatgcagctgccatagacgtgcctggtccagaggtcacacgcttagctgctatggctgggaaatataaggtctttctggtaatgggagtgattgagagagaaggttacacactgtattgttcagtgctcttctttgaccctctaggtcggtacctgggtaagcaccgcaagctcatgccgacggcattagaaaggataatatggggatttggagatggatcaacaattcctgtttatgacactccacttggaaaaattggagctcttatttgctgggaaaataagatgccactgttaaggacagcactgtatggcaaaggtattgagatatattgcgctcccacggctgattcgaggccagtctggcaagcttccatgacacacatcgccatggaggggggatgctttgtgttgtcggcgaaccagttctgccgcagaaaggactaccctccgccatccgagtacgcctttgccggtttaggagaagagccgtctccagacaccgttgtttgccctggaggcagtgttatcatttcgccgtcaggggaagtcctggcaggtcccaactacgacggagaggcgctgatcacagccgaccttgacatgggagagatcgttcgggccaagtttgatttcgacgtggtgggccactacgctcggcctgaggtgctgggcttggtggtggacgaccagccgcaccgtccggtgtccttcacctctgccgctgagaaggccccggctgccaagagcgacggcgccgcaaagccctgaccgcctgacgaccatcagctcagtcacaaagcagttgattgataactatcgatagttctctttttgtgtgatgaaaggacttctgttggtagcttaataaggcgatgaaatgtgggctcggatcgcccgcatgtctgacgcccctgtaactttcgctgcttgtaaagtgcattcccgaacaatcagctgaggtccgttcaccatgggcgtgttkggttgcccgggtggctctagcctgcatcgcatgggggatcctgggtgagcgtggcctggttgaggtgatacagagatgagctaagatgtg

SEQ ID NO: 393 - DNA, 1554 bp, Zea mays
  misc_feature (1533)..(1533): n is a, c, g, or t
  misc_feature (1535)..(1535): n is a, c, g, or t
  misc_feature (1538)..(1538): n is a, c, g, or t
agagaaggcactggaaactctgaagcgtcgcagaacgctcctccctctaaggctccgacctccgtgcctcgcgcgccctcgcccttgccctcgccctcccccaccaacccaaaacccgatccgttgctcgctgctcagggtccactactgatccgctccacgcgagctcccttgtccccgcgtcacactcgcgcccaagcaagcggttgctgcaaaggaagcctcccctgatggctctcgtgacctcgggctcgggtgccgaccaggtgatcgccgaggtggcgatgaacggcggcgccgacccaagtgcaaccaccgtgcgtgctactgtcgtgcaggcgtccaccatcttccacgacacgcccgccactcttgataaagcagagagattgatagcagaggctgctgggtatggttcacagttagttgtctttccagaagcttttattggaggctatcctcgtggatccacatttggtttcgggatcagtattagtattattaatccaaaagacaagggaaaggaagcattccggaggtatcatgcatctgctatagatgtgcctggtccagaagttacacgcttggctgctatggctgcaaaatataaggttttcttggtcatgggggtgattgaaagggaaggttacaccctttattgttccgtgcttttctttgaccctcttggccgttacctgggtaagcaccggaagctcatgcctacagcattagagagaattatatggggatttggggatggatcgactattccagtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactatcctcccccaccggagtatgagtttgctggtttaggtgaagagccatccgcggacactgttgtttgccctggaggcagcgttatcatttctccatctggagaagtcttggcaggtcccaactatgaaggagaggcactgattacagccgaccttgacctgggagagattgttcgagccaagtttgatttcgacgtggtgggccactattctcgacctgaagtccttagattggtagtgaacgaccaaccgcagctccctgtgtctttcacgtctgccgctgagaggactccagctgccaagagtgatatcgatactaagtcttactgattgactggtcatgaaactgtgttgcgccgaacacttggtgatggtcgctcagctcctctagtttgctgttgtgtctcgtggatgggagttgggagttgtagctttgaactaaaaaaaaaactcttgccttcccaacgtaaaaaaatggtggccgcagttatgttccttgtgaaagctgttcgcttggctttaatctaaaactgcttctgcgccccananccnagcaagacgaatgggt

SEQ ID NO: 394 - DNA, 1593 bp, Zea mays
  misc_feature (1572)..(1572): n is a, c, g, or t
  misc_feature (1574)..(1574): n is a, c, g, or t
  misc_feature (1577)..(1577): n is a, c, g, or t
gaacgctcctcgccctaaggctccgtcgaggccggccgggagrgaaggcacyggractcaaaaaaaacaaagaacgctcctccctctaaggctccgacctccgtgcctcgcgcgccctcgcccttgccctcgccctcccccaccaacccaaaacccgatccgttgctcgctgctcagggtccactactgatccgctccacgcgagctcccttgtccccgcgtcacactcgcgcccaagcaagcggttgctgcaaaggaagcctcccctgatggctctcgtgacctcgggctcgggtgccgaccaggtgatcgccgaggtggcgatgaacggcggcgccgacccaagtgcaaccaccgtgcgtgctactgtcgtgcaggcgtccaccatcttccacgacacgcccgccactcttgataaagcagagagattgatagcagaggctgctgggtatggttcacagttagttgtctttccagaagcttttattggaggctatcctcgtggatccacatttggtttcgggatcagtattagtattattaatccaaaagacaagggaaaggaagcattccggaggtatcatgcatctgctatagatgtgcctggtccagaagttacacgcttggctgctatggctgcaaaatataaggttttcttggtcatgggggtgattgaaagggaaggttacaccctttattgttccgtgcttttctttgaccctcttggccgttacctgggtaagcaccggaagctcatgcctacagcattagagagaattatatggggatttggggatggatcgactattccagtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactatcctcccccaccggagtatgagtttgctggtttaggtgaagagccatccgcggacactgttgtttgccctggaggcagcgttatcatttctccatctggagaagtcttggcaggtcccaactatgaaggagaggcactgattacagccgaccttgacctgggagagattgttcgagccaagtttgatttcgacgtggtgggccactattctcgacctgaagtccttagattggtagtgaacgaccaaccgcagctccctgtgtctttcacgtctgccgctgagaggactccagctgccaagagtgatatcgatactaagtcttactgattgactggtcatgaaactgtgttgcgccgaacacttggtgatggtcgctcagctcctctagtttgctgttgtgtctcgtggatgggagttgggagttgtagctttgaactaaaaaaaaaactcttgccttcccaacgtaaaaaaatggtggccgcagttatgttccttgtgaaagctgttcgcttggctttaatctaaaactgtttctscgccccananccnagcaagacgaatgggt

SEQ ID NO: 395 - DNA, 1598 bp, Oryza sativa
tgatggatttcgctccctcgtcttctgctcctagtcacacttgacagttcagcttcagctcctcccccaccatctccctcctcgccgccggcccccatttctcccgcgtccacttcgagcggcggcgcgcgtgccgtaccgatggctatggtcccctcgggctcgggcggtgggccgccggtgattgcggaggtggagatgaacggcggcgccgactcgggcgccgccacggtcagggccaccgtcgtgcaggcctccaccgtgttctacgacaccccggccactctagataaagcagagaggttgatagaggaggctgctgggtatggttcacagttggttgtgttcccagaagcttttgttggcggctatcctcgtggatccacatttggctttggggccaacataagcattggtaatccaaaagacaaggggaaggaagaattccggaagtatcatgcggcggcaatagaagtgcctggcccagaggtgacacgcttggctgctatggctggaaaatataaagtatttttagtgatgggagtgattgaaagggaaggttacactctgtattgctcggtgctcttctttgatcctctaggacggtacctaggtaagcaccgaaagctcatgccaacagcattagaacgaataatatggggatttggagatggatcaacaattcctgtttatgatactccacttggaaagatcggagccctaatttgctgggaaaataaaatgccactgttgcggacagcactttatggtaaaggtattgagatatattgtgctccaactgctgattccagacaagtttggcaagcctccatgactcatattgccttagaggggggatgctttgtcctgtcagcaaatcaattctgccgtagaaaggactatcctccaccaccggagtatgtattttctggtttaggtgaagagccttctccagacactgttgtctgccctggaggtagcgtcatcatttcaccatccggagaagtcttggcaggtcccaactacgaaggggaggcgctgattacagctgatctagaccttggagaaatcgtgcgagccaagtttgattttgatgtggtgggccactatgctcgacctgaggtcttgagcttggtagtgaatgaccagccgcacctccctgtgtctttcacttctgccgctgtgaagacgacagccgcaaaaagtgacagcactgcaaagccctactaagcaagataatcagagtcaatcgcaaaactgattactgtcactagacggtgaatcattggctccgatcgttcatgcttgacgtccctgtcatccccttgcttgtaaattgcagtccagaacaaacttctgaggtctgtagaacttgccccttttatgctgtgtatctatcaaggtaggtgtcagatcaaacttggttcccctccatatcaaatatgagtagtgcatgaactggcactacgatggtttcactgtcacacatgtggttattttacgttctactcccttggtgccatattacagattattttagttttatcataagttaaacttctctaactttggctgaggatatagaaaattgctacaat

SEQ ID NO: 396 - DNA, 1546 bp, Oryza sativa
  misc_feature (1539)..(1540): n is a, c, g, or t
  misc_feature (1543)..(1543): n is a, c, g, or t
  misc_feature (1545)..(1545): n is a, c, g, or t
ggtcttctgctcctagtcacacttgacagttcagcttcagctcctcccccaccatctccctcctcgccgccggcccccatttctcccgcgtccacttcgagcggcggcgcgcgtgccgtaccgatggctatggtcccctcgggctcgggcggtgggccgccggtgattgcggaggtggagatgaacggcggcgccgactcgggcgccgccacggtcagggccaccgtcgtgcaggcctccaccgtgttctacgacaccccggccactctagataaagcagagaggttgatagaggaggctgctgggtatggttcacagttggttgtgttcccagaagcttttgttggcggctatcctcgtggatccacatttggctttggggccaacataagcattggtaatccaaaagacaaggggaaggaagaattccggaagtatcatgcggcggcaatagaagtgcctggcccagaggtgacacgcttggctgctatggctggaaaatataaagtatttttagtgatgggagtgattgaaagggaaggttacactctgtattgctcggtgctcttctttgatcctctaggacggtacctaggtaagcaccgaaagctcatgccaacagcattagaacgaataatatggggatttggagatggatcaacaattcctgtttatgatactccacttggaaagatcggagccctaatttgctgggaaaataaaatgccactgttgcggacagcactttatggtaaaggtattgagatatattgtgctccaactgctgattccagacaagtttggcaagcctccatgactcatattgccttagaggggggatgctttgtcctgtcagcaaatcaattctgccgtagaaaggactatcctccaccaccggagtatgtattttctggtttaggtgaagagccttctccagacactgttgtctgccctggaggtagcgtcatcatttcaccatccggagaagtcttggcaggtcccaactacgaaggggaggcgctgattacagctgatctagaccttggagaaatcgtgcgagccaagtttgattttgatgtggtgggccactatgctcgacctgaggtcttgagcttggtagtgaatgaccagccgcacctccctgtgtctttcacttctgccgctgagaagacgacagccgcaaaaagtgacagcactgcaaagccctactaagcaagataatcagagtcaatcgcaaaactgattactgtcactagacggtgaatcattggctccgatcgttcatgcttgacgtccctgtcatccccttgcttgtaaattgcagtccagaacaaacttctgaggtctgtagaacttgccccttttatgctgtgtatctatcaaggtaggtgtcagatcaaacttggttcccctccatatcaaatatgagtagtgcatgaactggcactacgatggtttcactgtcacacatgtggttattttacgttctactcccttggtgccatattacagattattttagttttatcataagttaannttntnt

SEQ ID NO: 397 - DNA, 1698 bp, Sorghum bicolor
aggttctcttgctgggtgttggtctctcgccttcgtccaacttcgcttgtaacattatccttttttaatgaaaaacagactaaatttccgatcgtgaaaaagaaaagtcatgactgaaagtattgttcgctgatttattatgaaagaaaaacatttttgattagcagaaaaaatacagatcttataacacatgatacttgatgcgaacttgcattcgtgtacctgcagactgctgctgccgctctcagtccttctccttccttattataaaccgcccactggcctggtagtggttggtgctctccggcagttctgctcctctgcacggcctctctcgcctccggtatccacctctccttccttccttcacatcgagccgcgatatataataagtagctagccggccggagacgacgacgatggccctcgctccagcgagctccggcaaagagcccgtgatcagcccgccggaggtggagatgaacggcggcgctgaccagcccgccgccacaaccgtgcgtgcctccgtcgtgcaggcgtcgtccgtgttctacgacacccccgccactctcgataaagcggagaaattcatagcggaggcagccggaaacggttcacagctggtgctatttccagaagccttcattggtggctaccctcatggatctacatttggactggctattggcaatcgcactgccaagggaaaggaagacttccaaaagtaccatgcagctgccatagatgttcctggcccagaagtgtcccgcttagcttcattagccggaaaatacaaggtgtttctggtgatgggggtggttgaaagggcaggctatacactctacaacacggcgctcttcttcgatcctctgggaaaatttctagggaagcaccgcaagctcgtgcctactgcactggaacgtacattctggggttttggagatggatctacgctgcccgtctttgataccccgttgggaaaaatcggtgccctcctctgctgggaaaacaagatgccacttgccaggacagccatgtacgccaaagggattcagatatattgtgctcccacagctgatgcgtccccaacttgggtggcttccatgacgcatatcgccctcgaagggggatgcttcgtggtgtcggcaaaccagttctgtcgcaggaaggactacccaccccctccggagtatacattcggtggcctcgacgaagagccatccccggagactgttgtgtgtcctggaggaagtgtcatcgtttcaccgtccgggacagtgttggcaggccccaacttcgagggtgagggcctcgttacagctgacctcgaccttggagagattgttcgagccaagtttgatttcgacgtggtggggcactactcgcgacgtgaggtgctgagtttggtggtgaagactgatccaaagtctgctgtctctttcactgcttcagccgatggagagaggccggcttccgctgggaagaagcgcgacgactctgtgtacaaataatggccacgtatctgtaatctttccttatacgccaattgcaagtttgccactactacatcgcaactattgcgggcttttcctgtacgtctctgaataataaactgtttatgtacacaacagtcgatgtatattatcctacagatatgagatcgatctcttggttgatggaatcgtacgtgtcagtttg

SEQ ID NO: 398 - DNA, 1963 bp, Sorghum bicolor
aggttctcttgctgggtgttggtctctcgccttcgtccaacttcgcttgtaacattatccttttttaatgaaaaacagactaaatttccgatcgtgaaaaagaaaagtcatgactgaaagtattgttcgctgatttattatgaaagaaaaacatttttgattagcagaaaaaatacagatcttataacacatgatacttgatgcgaacttgcattcgtgtacctgcagactgctgctgccgctctcagtccttctccttccttattataaaccgcccactggcctggtagtggttggtgctctccggcagttctgctcctctgcacggcctctctcgcctccggtatccacctctccttccttccttcacatcgagccgcgatatataataagtagctagccggccggagacgacgacgatggccctcgctccagcgagctccggcaaagagcccgtgatcagcccgccggaggtggagatgaacggcggcgctgaccagcccgccgccacaaccgtgcgtgcctccgtcgtgcaggcgtcgtccgtgttctacgacacccccgccactctcgataaagcggagaaattcatagcggaggcagccggaaacggttcacagctggtgctatttccagaagccttcattggtggctaccctcatggatctacatttggactggctattggcaatcgcactgccaagggaaaggaagacttccaaaagtaccatgcagctgccatagatgttcctggcccagaagtgtcccgcttagcttcattagccggaaaatacaaggtgtttctggtgatgggggtggttgaaagggcaggctatacactctacaacacggcgctcttcttcgatcctctgggaaaatttctagggaagcaccgcaagctcgtgcctactgcactggaacgtacattctggggttttggagatggatctacgctgcccgtctttgataccccgttgggaaaaatcggtgccctcctctgctgggaaaacaagatgccacttgccaggacagccatgtacgccaaagggattcagatatattgtgctcccacagctgatgcgtccccaacttgggtggcttccatgacgcatatcgccctcgaagggggatgcttcgtggtgtcggcaaaccagttctgtcgcaggaaggactacccaccccctccggagtatacattcggtggcctcgacgaagagccatccccggagactgttgtgtgtcctggaggaagtgtcatcgtttcaccgtccgggacagtgttggcaggccccaacttcgagggtgagggcctcgttacagctgacctcggtaagaaaccagaccgccgattcatatgaattctactgaaaatgtgacagttaacagcctattcgtttaagtttatccgccgaatctacccgtcatttataacaaattaatgaatactactttctgtcatgacttatcagcaaacgaacgagactatgcttgaatgatttttgttctgagacagctcagctctcagtagaaactgcctaattatggtttggttcacagaccttggagagattgttcgagccaagtttgatttcgacgtggtggggcactactcgcgacgtgaggtgctgagtttggtggtgaagactgatccaaagtctgctgtctctttcactgcttcagccgatggagagaggccggcttccgctgggaagaagcgcgacgactctgtgtacaaataatggccacgtatctgtaatctttccttatacgccaattgcaagtttgccactactacatcgcaactattgcgggcttttcctgtacgtctctgaataataaactgtttatgtacacaacagtcgatgtatattatcctacagatatgagatcgatctcttggttgatggaatcgtacgtgtcagtttgtggctaccttgcatttgttggtcacctcatgagatcg

SEQ ID NO: 399 - DNA, 2097 bp, Sorghum bicolor
agttctcactcattttcttgcacttgtatcagtatattagaatccccttccttacaagtcttaggccctatttaaatttcatggtctaagttttagttatctaaagtcaatggctaaatgttagaccattttagatagcagttttgattatatatctggagcctcaagaactaaagtgatctaaaatttaggtgctaaattttagaccttcatgaatcaaagaagaccttattttttttgattagtacctttgcacaaaaaagaaagaaagaaaacgagccacsagtgacgagcctactcgaagcatcgtgatatactagaataggaggttcctccctccctccctgcctcaatccaccaaaccaaaacccgcccggttctcaggatccgctccacgcgagctcccctgtccccagctccccgcctccgcgtcgcgctcgcgcccaagcaagtgctagcaggctagcagcaaagcaagccttccctgatggctctggtgccctcaggctcgggtgccggccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaagctgctgggtatggttcacagttagttgtctttccggaagcttttattggaggctatcctcgtggatccacatttggcttcgggatcagtattagtattattaatccaaaagacaagggaaaggaagcattccggaggtatcatgcagctgctatagatgtgcctggtccagaggttacacgattagctgctatggctggaaaatataaggttttcttggttatgggggtgattgaaagggaaggttataccctttattgttcagtgcttttctttgatcctcttggccgttacctgggtaagcaccgcaagctcatgccaacagcattagagagaattatatggggatttggggatggatcgactattcctgtttatgatactccacttggaaagattggggcgctcatttgctgggaaaataaaatgccacttttgaggacagcgctgtatggtaaaggtaagagtcagtctcatgttgataaatttccaagatagcttacattcattggatggaagccttgaattgaaatggaaataaacctgcaacaaaagtcagataagcaattgctgaagaggcattgacaccagaatatgtattgagtttcttagcttatgtaatgtgcaggtattgagatatactgtgcccccactgctgactccaggcctgtttggcaagcctccatgacacacattgctttggaggggggatgctttgtcttgtcagcaaaccaattctgccgcagaaaggactaccctcccccaccggagtatgagtttgctggtttaggtgaagagccatctgcagacactgttgtttgctctggaggcagcgttatcatttctccatctggagaagtcttagcaggtcccaactatgagggagaggcactgattacagccgaccttgacctgggagagattgttcgagccaagtttgatttcgacgtggtgggccactattctcgacctgaagtccttagcttggtagtgaatgaccagccacatctccctgtgtctttcacgtctgccggtgagaagactccagctgccaagagtgacagcgatgctaagtcttactgattgagtgtggccatgaaactatgttgtaccgaagccttggtgaaggtcgctcagctcctctggtttgctgtttgtgtgtcgtggatgggagttgggaattgtagcttttgaactctaaaagttctctttaatgaggcggaaaaaatagtagatgcagttatgttgcttgtaaagtcttgtattcggtgaataactctgccagaactatgaatcctattactatcgttgtagtttcgaatagtaccaaatgataatcgcccgttttgggctgcatatgtttattttgtcttgttttctaagaagaactatgaatcctgagttagctagaattggagaaccaaatctgaacatgatta

SEQ ID NO: 400 - DNA, 1950 bp, Sorghum bicolor
agttctcactcattttcttgcacttgtatcagtatattagaatccccttccttacaagtcttaggccctatttaaatttcatggtctaagttttagttatctaaagtcaatggctaaatgttagaccattttagatagcagttttgattatatatctggagcctcaagaactaaagtgatctaaaatttaggtgctaaattttagaccttcatgaatcaaagaagaccttattttttttgattagtacctttgcacaaaaaagaaagaaagaaaacgagccaccagtgacgagcctactcgaagcatcgtgatgatatgatagaatagaaggttcctccctccctccccctcgctccaccaaaccaaaacccgcccggttctcagggtccactagagcactactgatccgctccacgcgagctcccctgtccccagctccccgcctccgcgtcgcgctcgcgcccaagcaagtgctagcaggctagcagcaaagcaagccttccctgatggctctggtgccctcaggctcgggtgccgaccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaggctgctgggtatggttcacagttagttgtctttccggaagcttttattggaggctatcctcgtggatccacatttggcttcgggatcagtattagtattattaatccaaaagacaagggaaaggaagcattccggaggtatcatgcagctgctatagatgtgcctggtccagaggttacacgattagctgctatggctggaaaatataaggttttcttggttatgggggtgattgaaagggaaggttataccctttattgttcagtgcttttctttgatcctcttggccgttacctgggtaagcaccgcaagctcatgccaacagcattagagagaattatatggggatttggggatggatcgactattcctgtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactaccctcccccaccggagtatgagtttgctggtttaggtgaagagccatctgcagacactgttgtttgctctggaggcagcgttatcatttctccatctggagaagtcttagcaggtcccaactatgagggagaggcactgattacagccgaccttgacctgggagagattgttcgagccaagtttgatttcgacgtggtgggccactattctcgacctgaagtccttagcttggtagtgaatgaccagccacatctccctgtgtctttcacgtctgccggtgagaagactccagctgccaagagtgacagcgatgctaagtcttactgattgagtgtggccatgaaactatgttgtaccgaagccttggtgaaggtcgctcagctcctctggtttgctgtttgtgtgtcgtggatgggagttgggaattgtagcttttgaactctaaaagttctctttaatgaggcggaaaaaatagtagatgcagttatgttgcttgtaaagtcttgtattcggtgaataaaccctgccagaactatgaatcctattactatcgttgtagtttcgaatagtaccaaatgataatcgcccgttttgggctgcatatgtttattttgtcttgttttctaagaagaactatgaatcctgagttagctagaattggagaaccaaatctgaacatgatta

SEQ ID NO: 401 - DNA, 1911 bp, Saccharum officinarum
aaggccgctggtgaggaggtcggcgacgtccttcttgaggaacttgaccatggcttgcttcttccgccgcagcagatccagccgagtccgggtgcacttgattgcgtgcttgcatttgttgtagaacttggagttgagcaaactgtcaaacatcttgcccgctccctcggtccccctctcctgcgcttctccctgttctcttcttcggttcttctcctgcagctcctccccctgctttaaccagtggcagaggagatggtgggaggcaggcagaggcggccaaagctgcgagctgtggcgtcaaagcatcagaaagagaggagaaaaaggaagaagagagagagagagagagagagagaagagagaggtggtggtggtggtggtgkcggccwsgsgkgygctccccggcagctcctcgccttcggtatccacctctcctacgttcgttcacatcgagccccagcgtccgcgactagccgagacccgagactacctccgcaggaagcacgatatatacaataagtggccggagacgacgatggccctggctccagcgagctccggcaaagaacccgtggtcccggaggtggagatgaacggcggcgccgaccagcccgccgccacaaccgtgcgggccaccgtcgtgcaggcgtcgtccgtgttctacgacacccccgccactctcgataaagcggagaaatttatagcggaggcagccggaaacggttcacagctggtggtatttccagaagccttcattggtggctaccctcatggatgtacctttggactggctattggcaatcgcactgccaagggaaaggaagactttcgcaagtatcatgcagctgccatagaagtccctggtattctcaattaaaacgatgttaatgtgtgtccatgttttattcttcacgaatgttaaacatattgcttctatagaacactttacaaatgctgcttgtgcaagtccctggcccagaagtgtcccgcttagcttcattagccggaaaatacaaggtgtttctggtgatgggggtgattgaaagggcaggctatacactctacaacacggcgctcttcttcgatccgctgggaaaatacctagggaagcaccgcaagctcgtgcctactgcactggaacgtgtgttctggggttttggagatggctccacgttacccgtctttgataccccgttgggaaaaatcggtgccctcctctgctgggaaaacaagatgccacttgccaggacagccatgtacgccaaaggtattcagatatactgtgctcccacagctgatgcgtccccgacttgggtggcttccatgacgcatattgccctcgaagggggatgcttcgtggtgtcggcaaaccagttctgtcgcagaaaggactaccctccccctccggagtacacattcggtggactggacgaagagccatccccagagactgttgtgtgtcctggaggaagtgtcatcgtttcrccgtccgggacagtgttggcaggccccaacttcgagggcgagggcctcgttacagctgacctggaccttggagagatcgttcgagccaagttcgatttcgacgtggtggggcactactcgcgacctgaggtgctgagcttggtggtgaagactgatccaaagcctgctgtctctttcactgcttcttcagccgatggagagagggcttccgcggggaagggcgacgactcgctggtcgctgcagacatgatggccacatatctttaatctttccttgtacggcaattgcaagtggccactaytacatcgcaataattgcgggctttccctgtacgtctctgaataataaactgttactgtacaaatatgatgaggtctcttgattgaagaaaaaaattgaaagaaaaaagttaagaaaaatat

SEQ ID NO: 402 - DNA, 1916 bp, Saccharum officinarum
tgatatgattgaatagaatagaacgttcctccctccctgmctcgccccaccaaaccaaaacccgcccggttctcagggtccatcgtccactactgatccgctccacgcgagctcctcttgtccccggctccccgcctccgcgtcgcgctcgcgcccgagcaagtgctagcaggcttagcagcaaagcaagcctcccctgatggctctggtgccctcaggctcgggtgccggccaggtgatcgccgaggtggcgatgaacggcggcgccgacccgaacgcgaccaccgtgcgcgctaccgtcgtgcaggcgtccaccatcttccacgacacgcccgccactctcgataaagcagagagattgatagcagaggctgctgggtatggttcacagttggttgtctttccagaagcttttattggaggctatcctcgtggatccacatttggcttcgggatcagtattagtattattaacccaaaagacaagggaaaggaagcattccggaggtatcatgcagctgctatcgatgtgcctggtccagaggttacacgcttggctgctatggctggaaaatataaggttttcttggtcatgggggtgattgaaagggaaggttataccctttattgttcggtgcttttctttgatcctcttggccattacctgggtaagcaccgcaagctcatgcctacagcattagagagaattatatggggatttggggatggatcaactattcctgtttatgatactccacttggaaagattggggcgctcatttgctgggaaaataaaatgccacttttgaggacagcgctgtatggtaaaggtattgagatatactgtgcccccactgctgactccaggcctgtttggcaagcctccatgacacacattgctttggaggggggatgctttgtcttgtcagcaaaccaattctgccgcagaaaggactacccccctccaccggagtatgagtttgctggtttaggtgaagagccatctgcagacactgttgtttgccctggaggaagcgttatcatttctccatctggagaagtcttggcaggtccgaactatgagggagaggcactgattacagccgaccttgacttgggagagattgttcgagccaagtttgattttgacgtggtgggccactattctcgacctgaagtccttarcttggtagtgaatgaccaaccacatttccctgtatctttcacgtctgccgccgagaagactccagctgccaagagtgacagcgatgctaagtcttactgattgagtgtggccatgaaactattatgttgtaccgaagccttggtgaaggtcgctcagctcctctggtttgctgtttgtgtgtcgtggatgggagttgggagttgtagcttttgaactctaaaaattctctttaatgaggcagaaaaaatggtggatgcagttatgttccttgtcacgacatgacttatgtgtataaacaatggctgaactttgacccctcactatgcaagatgtcatatatgtagactaaggcattataataggtcacctaggtgttccctacacaagtactccctcgcactgtgagtcttgtagccacttcaaatacatcaaaatctgctcccatcacaccaactttcttaggtgttccgcaatatcctcctgcttggcatgcttgaccacttatgcttatctaggtcattctcttagttaattgagcaaggttcctacggtttcatacctttgacagaataaattatggttggtttgggcatggtttagttgaacggttgaaccactcttattttgtttatttgtctctgtacaagcttagagtgtacttggtcttatagcatcaacacgtggatatcctatagcttgccccctctttacccctcttatgtgtttatct

SEQ ID NO: 403 - DNA, 1922 bp, Triticum sp.
ccacgcgtccgggagccgtggattgattggcgctctctttgtatagtagtagttcactcacccgctccggcgctccccggtccccaccatccccgctttcccctccaatgcccacctctgcttccaatccaacttccacatcaagctccagttcgtccgtaagcctcagcgtcggaagtagcgcgatcgatcgagagagtttcccgggcccacactgatggctctggttccctcgggctcaggcggcgcgccggtgatcgccgaggtggagatgaacggcggcgccgaccagagcgccaccatcgtgcgagccaccgtcgtgcaggcctccaccgtcttctacgacacccccgccactctcgataaagcagagagattaatagcagaggctgctggatatggttcacagttggtggtgttcccggaagcttttgttggtggttatcctcgcggatccacctttggctttgggatcagtattagtatcactaatccaaaagacaaaggaaagcgtgaattccagaagtattatgcagccgccatagacgtgcctggtccagaggtgacacgtttagctgctatggctgggaaatataaggtctttctggtaatgggtgtgattgagagagaaggttacacactgtattgttcagtgctcttctttgaccctctaggtcggtacctgggtaagcaccgcaagctcatgccgacggcattagaacggataatatggggatttggagatggatcaacaattcctgtgtatgacactccacttggaaagattggagcccttatttgctgggaaaataagatgccacttttgaggacagcactgtatggtaaagggattgagatatactgcgctcccacggctgattcaaggccagtttggcaagcttccatgacacacatcgccatggaggggggatgcttcgtgttgtcggcaaaccagttctgccgcagacaggactaccctccgccgtccgagtacgcctttgccggtttgggagaagagccttctccggacaccgttgtttgccctggaggcagtgttatcatttcgccgtcaggcgaagtcctggcaggtcccaactacgatggagaggcgctcatcacagccgaccttgacatgggagagatcgtccgggccaagtttgattttgacgtggtgggccactactctcggcctgaggtgctgagcttggtagtggatgaccagccgcaccgcccggtgtcattcacctctgctgcggagaaggctccggctgccaagagcgacggcaccgcaaagccctgacgaccatcagctcagtcacaagcagttgattatcatcgatagttttctttttgtgtgaaacgacctctatcgatcgatagcttaataagccgatgaaatgtaggcttggatcacccgcagcttgtgacgggacaatcagctgaggtctgttcaccgtgtgatgcatctgatatccactgcctactgctgcccactgaaacagacgcagtgttaaaggcgtgtgatgctggagaaatgctcacaacgccctcacagccatccagttgcaagcctgcagcaatgtgcggtgctgtccaatgttttctctctactccgactccaatgtgcgtgtgatggcgatttttcgaacgtccggacaattttgatgacagctgttgaatggctaaaattgttcgaacgttccggtctggataatttggtgacctgcttggagtttccctaagtttagcacttttattttccgaaaaatcccatatgcttattagtgcagctgcactaattgggttaatcgagcgtacgcgctacacaacaaaaaattcacacaacatggggtgcatccgagcagacctgtcataaagggtaattagcatcatgtgtcatcattacactacaaaatagaaac

SEQ ID NO: 404 - DNA, 1442 bp, Zea mays
tctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgtgtctcacttgttaggcttgtataaatatttgaccatgtgtactagcattacgaaaacagaaaagaagacagacagccgtgataggggacaatgatgcgatctaggagtacaaacagagtctagtttccactcagttgagttttatattgctctcaagcgttatcaagggtttagtaggatacagatataa

SEQ ID NO: 405 - DNA, 1925 bp, Zea mays
  misc_feature (248)..(248): n is a, c, g, or t
aatccttactatattaggcataaaattaggtgtagtttatttatttactggtactacttctttagtcataattaggtgtactagcagctacgccctgacggagacaagcacacacaatagaaaagagcgccctcgtgctcagagtgctcgcctttagtttcgtggctactatatactagttgcgacgatttttattttctttctcttctgggctatcattagcacggccatttaggggtaatgagcancggccaataaacaaagccctgagatgcatggggtagccaatcgggtgtcgccgtgcgcgcgcgcgcgcgtctggcctcctccttccctttccttgctaaataaagcaagtagcagataggggaaagtctgctcgcaagttgcatccgccctgcgccaagaaaagccatcgttcttcccacaaacgcacacatagaagcatcattcccctctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacccttgttaggcttgtataaatatttgaccttgtgtactagcattacgaaaacagaaaagaagacagacagccgtgataggggacaatgatgcgatctaggagtacaaacagagtctagtttccactcagttgagttttatattgctctcaagcgttatcaagggtttagtaggatacagatataattaagatacagtggttaaatcgc

SEQ ID NO: 406 - DNA, 935 bp, Oryza sativa
aaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 407 - DNA, 1125 bp, Oryza sativa
caacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggctccaattgcatccatgacaatttatggtgtggaagtgttgcctatattttcactattcttaagggctacagttcagagctcttaaaatgtattggtcataaagaagctaacacataacaagacacagtttgcatgcttggatgattaatatctgatactgtaaaatctattcgaataaaaatgtattatccg

SEQ ID NO: 408 - DNA, 1067 bp, Oryza sativa
  misc_feature (270)..(270): n is a, c, g, or t
atcaaattcccctataagctttggcctctttgcagctttcttctaccagctcccagctagatcccctcttgccttctttggcacattcgttcttgctctctgctgtggattatttgcctccggctccggccaatcggcggcgtggcgcgggcagatcgatcgatctcatcggcggcggggattgcctgttctagctatagcttgatagcttagctagcttggtcatttctggtgagagatcgatcgagatagcggcgaagaagatggggnagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 409 - DNA, 1310 bp, Oryza sativa
atcaaattcccctataagctttggcctctttgcagctttcttctaccagctcccagctagatcccctcttgccttctttggcacattcgttcttgctctctgctgtggattatttgcctccggctccggccaatcggcggcgtggcgcgggcagatcgatcgatctcatcggcggcggggattgcctgttctagctatagcttgatagcttagctagcttggtcatttctggtgagagatcgatcgagatagcggcgaagaagatggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaagaaaaaaaaaactattcatgccatagtgattgagaaatggacttgtatactggaaataaatgccacagtggaattgagttgtggaatccaggcaatgagtgttttatgattcaatttttccatgtatttttcatatattaaccagtgcgggcttgtgtaaaaaatataaccaggcaaggaaaattagctgtattgtgcatatggagcaaatttcaggcgttactaccattaaaatcatgacatgct

SEQ ID NO: 410 - DNA, 1189 bp, Triticum sp.
tcagcctatctgggaaacctgggaactttctccttccagagctccggcagctagatccacccagcttatctatytccatcgccmtcttgctctgcaccgggtagcttagcttgtcctctgcgtgtgggaggtagttgaagatggggcgcggcaagatagtgatccggcggatcgacaactccacgagccggcaggtgacgttctcgaagcggaggaacgggatcttcaagaaggccaaggagctgggtattctctgcgatgccgaggtcggtctcgtcatcttctccagcaccggccgcctctatgagtacgccagctccagcatgaagtcagtgatagatcgatatggmcgagccaaggaggagcagcaacttgttgcaaaccccaactcggagcttaagttctggcaaagggaggcagcaagcttgagacaacaactgcacaacttgcaagaaaatcatcggcagttgatgggacaagatctttctggaatgggtgtcaaggaactgcagactctagaaaatcaactggaaataagcctgcgttgcatccggacaaaaaaggaccaaatcttgattgatgagattcatgaactgaatcacaaggggagtcttgtccaccaagaaaacatggaattatacaaaaagattaacctaattcgtcaagaaaatgctgagttacaraaaaagctctctgagacggaggcagcgactgaagttaaccgagattcaagaactccatacaattttgcagttgttgaagatgccaatgtttctgttgatcttgaactcaattccccgcagcaacaaaatgatgttgagcatactgcgccccctaaactaggattgcaactacatccatgacgatcgtggggtatgggattactcttgttgttattattctcaagggatacaattcagagcagccagaatactcttggttgtaaagaacctaaacccatagcaagacataagtggttcgcatgtgacgaccgattgataaacggtagtgtaaatctgttacaaataaaatgtactccatggaaggattaatctgttgtgcaaatggttgtattagaactatttaacacattctgcgagtttgttcaactgcatgagcggctagcttattgacaaaaggtgtgaagtgtggattgagcaaaattcagttaccacttttttctgtcttc

SEQ ID NO: 411 - DNA, 1925 bp, Zea mays; identical to SEQ ID NO: 405
  misc_feature (248)..(248): n is a, c, g, or t

SEQ ID NO: 412 - DNA, 935 bp, Oryza sativa; identical to SEQ ID NO: 406

SEQ ID NO: 413 - DNA, 1125 bp, Oryza sativa; identical to SEQ ID NO: 407

SEQ ID NO: 414 - DNA, 1067 bp, Oryza sativa; identical to SEQ ID NO: 408
  misc_feature (270)..(270): n is a, c, g, or t

SEQ ID NO: 415 - DNA, 1310 bp, Oryza sativa; identical to SEQ ID NO: 409

SEQ ID NO: 416 - DNA, 1189 bp, Triticum sp.; identical to SEQ ID NO: 410

SEQ ID NO: 417 - DNA, 724 bp, Zea mays
attgtgttgggcgagatcataaactacgtacagtcgctgcagtgccaggtggagttcctgtcgatgaagctgtcgaccgtcgatccgcgtcgggacctcgacgtgggctgcttcgtcgtccccagagacgacgtaacgatgcaggccaacaggctgtgcgcgcccgcgacgtcgtcgtcgagctcagccttctgctacgccgcgcggagtgttgttacgaacgccaaaggattcgagacgccggtgcccttggcgaaccatggcgtcgcggcggacgacaggccacttgagcggcggactcgagacgcaggtccccaggcggggagcttgtgggaagaggacgatctgcagagcctggtcctgatgggattccggagccgttgatcgttgacgctctgattaggctagggacgacagttcgtttccaccgaccgccaaccaaatcgagagttgcagggccacgtaacagcagggttgggctccaatcattgggaactctccatgattgtacacagacaggacgcttacacgctaatttccagctcagcggaggccaagaaatgaaacaaaaaaaaggcgaaaagaagatgtttttttctcgcatttccccccacgaatttgcagtttaatccgatgtaaggtaactcaatgtaattattaatggtatttgagtcttatagacatcaagttgatgaaattttatactacgcaagatgctttcggt

SEQ ID NO: 418 - DNA, 727 bp, Zea mays
aggtaccggtccggaattcccgggtcgacccacgcgtccgcgtgaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaatt

SEQ ID NO: 419 - DNA, 910 bp, Zea mays
ccctccgctctcttcaggtgaggagggaaatttttttgcgtgctcatgaagctgccgcaggacctcgtgccaggctgcagcaaggtaagtaaacatcgacggcccttgctcaaaattcggttgaaaacacacacatatttcaatttctaaagactcctcgacctcgtgaaggttaccgggaaggccgtgatgctggacgagatcataaactacgtacagtcgctgcagtgccaggtggagttcctgtcgatgaagctgtcgaccgtcgacccgcgccgggagctcgacgtgggctgcttcgtcgtccccagagacgacgtaacgatgcaggccaacaggctgtgcgcgcccgcgacgtcgtcatcgagcacagccttctgctacgccgcgcggagtgttgttacgaacgccaaaggattcgagacgccggtgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctagggacgacagttcgtttccaccgaccgccaaccaaagcgagagttgcagggccacgtaacagcagggttgggctccaatcattgggaactctccatgattgtgcacaaacaggacgcttacacgctaatttccagctcggcggaggccaagaaacgaaacaaaaaaaaaggcgaaaagaagatgtttttttctcgcattccccctcacgaatttgcagtttaatcgatgtaagataactcaatgtaattattaatggtatttgagtcttatagacatcaagttgatgaaattttatactacacaagatgctttcggt

SEQ ID NO: 420 - DNA, 1450 bp, Arabidopsis thaliana
gatccatctttttcccccaaattcatatccttccttagatatttttctccttcttcttcttcttctagattccagctactccagaagattcttcgacttaatctgatgtgattaggaagagtaatagagcaagagaagaatcagaaaaaaatggatccggcgactaattcaccgattatgccgattgatttaccgattatgcacgacagtgatcgttacgacttcgttaaagatattggctctggtaatttcggcgttactcgtctcatgaccgatagagtcaccaaggagcttgttgctgttaaatacatcgagagaggagaaaagattgatgaaaatgttcagagggagattatcaatcatagatcattgagacatcctaatattgtcaggtttaaagaggtgattttgacgccttcccatttggctattgttatggaatgtgctgctggtggagaactttatgagcggatttgtaatgccggacggtttagtgaagatgaggctcggttcttctttcagcagcttatatctggagttagctattgtcatgcaatgcaaatatgccatcgggatctgaagctggaaaatacattgttggacggaagtccggcacctcgtttaaaaatatgtgattttggatattccaagtcttctgttcttcattcccaaccaaagtcaactgttggtactcctgcatacattgcaccagagattcttcttcaacaggaatatgatggcaagcttgcagatgtatggtcttgcggtgtaacattatatgtaatgttggttggagcttatccattcgaggatccacaagagccacgagattatcgaaagacaatacaaagaatccttagtgtcacatactcgatcccagaggacttacacctttcaccagaatgtcgccatctgatatcgaggattttcgtggccgatcctgcaacaagaataactattccggagatcacatccgataaatggttcttgaagaatcttccaggtgatttgatggatgagaacagaatgggaagtcagtttcaagagcctgagcagccaatgcagagccttgacacgattatgcagataatatcggaggctacgattccgactgttcgtaatcgttgcctcgatgatttcatggcggataatcttgatctagacgatgacatggatgactttgattccgaatctgagattgatgttgacagtagtggagagatagtttatgctctctgagattcctgaggacaaagtctgttttgtccgtactgttgagacacaccagtggagttttgtcttagctccacacactccaccgttcatttttggatcgtttgttgttttttactctacaagctttggattcacatacatatgtattgtaatgtaatatgtaatatatttttatgtatttttctttgttttaataactattggcacattttat

SEQ ID NO: 421 - DNA, 1488 bp, Arabidopsis thaliana
ctttgtctttctcattcgtcgttgatccatctttttcccccaaattcatatccttccttagatatttttctccttcttcttcttctagattccagctactccagaagattcttcgacttaatctgatgtgattaggaagagcaatagaggaagagaagaatcagaaaaaatggatccggcgactaattcaccgattatgccgattgatttaccgattatgcacgacagtgatcgttacgacttcgttaaagatattggctctggtaatttcggcgttgctcgtctcatgaccgatagagtcaccaaggagcttgttgctgttaaatacatcgagagaggagaaaagattgatgaaaatgttcagagggagattatcaatcatagatcattgagacatcctaatattgttaggtttaaagaggtgattttgacgccttcccatttggctattgttatggaatatgctgctggtggagaactttatgagcggatttgtaatgccggacggtttagtgaagatgaggctcggttcttctttcagcagcttatatctggagttagctattgtcatgcaatgcaaatatgccatcgggatctgaagctggaaaatacattgttagatggaagtccggcacctcgtttgaaaatatgtgattttggttattccaagtcttctgttcttcattcccaaccaaagtcaactgttggtactcctgcatacattgcaccagagattcttcttcgacaggaatatgatggcaagcttgcagatgtatggtcttgcggtgtaacattatatgtaatgttggttggagcttatccattcgaggatccacaggagccacgagattatcgaaagacaatacaaagaatccttagtgtcacatactcgatcccagaggacttacacctctcaccagaatgtcgccatctaatatcgaggatcttcgtggctgatccggcaacaagaatcactattccggagatcacatccgataaatggttcttgaagaatctaccaggtgatttgatggatgagaaccgaatgggaagtcagtttcaagagcctgagcagccaatgcagagccttgacacgattatgcagataatatcggaggctacgattccgactgttcgtaatcgttgcctcgatgatttcatggcggataatcttgatctagacgatgacatggatgactttgattccgaatctgagattgatgttgacagtagtggagagatagtttatgctctctgagattcctgaggacaaagtctgttttgtccgtactgttgagacacaccactggagttttgtcttagctccacgcactccatcgttcatttttggatcgtttgttgttttttactctacaagctttggattcacatacatatatatgtattgtaatgtaatatgtaatatattctatgtatttctctttgtttaataactattggcacattttatacaaatgatatggtact

SEQ ID NO: 422 - DNA, 1440 bp, Arabidopsis thaliana
tccatttattttctcgaatcttcttcttcttcctagattccagcgacttaacaacaacaacaacaacatattctctgctgggtattagattcgaatttctctttttgtgatcagaaatggatcgagctccggtgaccacaggaccgttggatatgccgattatgcacgacagtgatcgatatgacttcgttaaggatattggttctggtaatttcggtgttgctcgtcttatgagagataaactcactaaagagcttgttgctgtcaagtacatcgagagaggagacaagattgatgaaaatgttcaaagggagatcattaaccacaggtcactaaggcatcctaatattgtcagatttaaagaggtcattttgacgccgactcatctggctatcataatggaatatgcttctggcggtgaactttacgagcggatttgcaatgcaggacggtttagtgaagatgaggctcggttcttctttcagcagcttctatctggagtcagttattgtcattcgatgcaaatttgccatcgtgacctgaagctagagaatacattgttggatggaagtcctgctcctcgattaaaaatttgtgattttggatattcaaagtcttctgttcttcattcacaaccaaagtcaactgttggtactcctgcatacatcgctccagaggtactgcttcgtcaggaatatgatggcaagattgcagatgtatggtcatgtggtgtgaccttatacgtcatgttggttggagcgtatccgttcgaagatccagaagagccaagagactatcggaaaacaatacagagaatccttagcgttaaatactcaatccctgatgacatacggatatcacctgaatgctgtcatcttatttcaagaatcttcgtggctgatcccgctaccagaataagcataccagagatcaaaacccatagttggttcttgaagaatctccctgctgatctaatgaacgagagcaacacaggaagccagttccaggagcctgaacaaccaatgcaaagccttgacacaatcatgcaaatcatctctgaagccacaattcccgctgttcgaaaccgttgcctagacgatttcatgactgacaatcttgatcttgacgatgacatggatgactttgactctgaatctgaaatcgacattgacagtagcggagagatagtttacgctctctaataaaaagccttttttaacaaccaaaacacttctctatctgttctaagaccagtagtgttctgatcctctggtttcaaattctaccaatttttgtattgtctctgtttgtttcttgttttcttcatgcacacatatatcatatatgtaatgtaaaatatcatctgtgtatattatatatatattccaatgtcacacaaaagcaaattaacagttaaaacagttgaagcaagttgaggtt

SEQ ID NO: 423 - DNA, 1471 bp, Arabidopsis thaliana
attcgttctcttcttgaagatatttttccatttattttctcgaatcttcttcttcttcctagattccagcgacttaacaacaacaacaacaacatattctctgctgggtattagattcgaatttctctttttgtgatcagaaatggatcgagctccggtgaccacaggaccgttggatatgccgattatgcacgacagtgatcgatatgacttcgttaaggatattggttctggtaatttcggtgttgctcgtcttatgagagataaactcactaaagagcttgttgctgtcaagtacatcgagagaggagacaagattgatgaaaatgttcaaagggagatcattaaccacaggtcactaaggcatcctaatattgtcagatttaaagaggtcattttgacgccgactcatctggctatcataatggaatatgcttctggcggtgaactttacgagcggatttgcaatgcaggacggtttagtgaagatgaggctcggttcttctttcagcagcttctatctggagtcagttattgtcattcgatgcaaatttgccatcgtgacctgaagctagagaatacattgttggatggaagtcctgctcctcgattaaaaatttgtgattttggatattcaaagtcttctgttcttcattcacaaccaaagtcaactgttggtactcctgcatacatcgctccagaggtactgcttcgtcaggaatatgatggcaagattgcagatgtatggtcatgtggtgtgaccttatacgtcatgttggttggagcgtatccgttcgaagatccagaagagccaagagactatcggaaaacaatacagagaatccttagcgttaaatactcaatccctgatgacatacggatatcacctgaatgctgtcatcttatttcaagaatcttcgtggctgatcccgctaccagaataagcataccagagatcaaaacccatagttggttcttgaagaatctccctgctgatctaatgaacgagagcaacacaggaagccagttccaggagcctgaacaaccaatgcaaagccttgacacaatcatgcaaatcatctctgaagccacaattcccgctgttcgaaaccgttgcctagacgatttcatgactgacaatcttgatcttgacgatgacatggatgactttgactctgaatctgaaatcgacattgacagtagcggagagatagtttacgctctctaataaaaagccttttttaacaaccaaaacacttctctatctgttctaagaccagtagtgttctgatcctctggtttcaaattctaccaatttttgtattgtctctgtttgtttcttgttttcttcatgcacacatatatcatatatgtaatgtaaaatatcatctgtgtatattatatatatattccaatgtcacacaaaagcaaattaacagttaaaacagttgaagcaagttgaggttatgtt

SEQ ID NO: 424 - DNA, 1074 bp, Arabidopsis thaliana
atggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagaggtgagaagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacagatgacgatatggaggaagacttagagagcgaccttgatgatcttgacatcgacagtagcggagagattgtgtacgcaatgtga

SEQ ID NO: 425 - DNA, 1634 bp, Arabidopsis thaliana
agagaaagctgtttcctttttatattgacagagaaaaggaaagctgatagagagagagacagagagagagaaacagagttcaagatcacgagccttccttcttcttcttcttcttcatcgagagcgatcaaaggaacaaaaaggatctcaagaaacccacttgtgttgttggttagatacttcacgggtctctgaaaacgtctctttctcacaaccataacttgatcacccaatactccttttctcatcttaaaggctcaaattcatccacgtcacaccgttgttcatttcctctgatgtcttggtgtcgttagatattgtctcccaaaaaagaaatcttcttgacacagagattgaagtcgcaaagagacagaggaaagagggggagaaaatggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagaggtgagaagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacaggaagcttggacatagatgacgatatggaggaagacttagagagcgaccttgatgatcttgacatcgacagtagcggagagattgtgtacgcaatgtgatactatatatctatttgcatggtttctgctacaaaaatgtcaaacaaaaaatgttgaagaataagattaagatgttttgcttgctattgagttggcccaactttgtctcaatgagtacactttgaatctttgatatgcaaaagactaaatttct

SEQ ID NO: 426 - DNA, 1289 bp, Arabidopsis thaliana
gacagagattgaagtcgcaaagagacagaggaaagagggggagaaaatggatcgaccagcagtgagtggtccaatggatttgccgattatgcacgatagtgataggtatgaactcgtcaaggatattggctccggtaattttggagttgcgagattgatgagagacaagcaaagtaatgagcttgttgctgttaaatatatcgagagaggtgagaagatagatgaaaatgtaaaaagggagataatcaaccacaggtccttaagacatcccaatatcgttagattcaaagaggttatattaacaccaacccatttagccattgttatggaatatgcatctggaggagaacttttcgagcgaatctgcaatgcaggccgcttcagcgaagacgaggcgaggtttttcttccagcaactcatttcaggagttagttactgtcatgctatgcaagtatgtcaccgagacttaaagctcgagaatacgttattagatggtagcccggcccctcgtctaaagatatgtgatttcggatattctaagtcatcagtgttacattcgcaaccaaaatcaactgttggaactcctgcttacatcgctcctgaggttttactaaagaaagaatatgatggaaaggttgcagatgtttggtcttgtggggttactctgtatgtcatgctggttggagcatatcctttcgaagatcccgaggaaccaaagaatttcaggaaaactatacatagaatcctgaatgttcagtatgctattccggattatgttcacatatctcctgaatgtcgccatttgatctccagaatatttgttgctgaccctgcaaagaggatatcaattcctgaaataaggaaccatgaatggtttctaaagaatctaccggcagatctaatgaacgataacacgatgaccactcagtttgatgaatcggatcaaccgggccaaagcatagaagaaattatgcagatcattgcagaagcaactgttcctcctgcaggcactcagaatctgaaccattacctcacaggaagcttggacatagatgacgatatggaggaagacttagagagcgaccttgatgatcttgacatcgacagtagcggagagattgtgtacgcaatgtgatactatatatctatttgcatggtttctgctacaaaaatgtcaaacaaaaaatgttgaagaataagattaagatgttttgcttgctattgagttggcccaactttgtctcaatgagtacactttgaatctttgatatgcaaaagactaaatttcc

SEQ ID NO: 427 - DNA, 1573 bp, Hordeum vulgare
  misc_feature (26)..(26): n is a, c, g, or t
ggaattgacaaaagcgcgcggccagnattaggaagaaaggttcgacagcgagataaggagagagagggggcgcgcggggacctccgtgtcagtcttgggcggcggtagagtcgtcggcgcgggggcgatggagagggggacgatgggcgacgtgccggtgatgctcgacggcgaccggtacgagctggtccgcagcatcggatccggcaacttcggcgtcgcccgcctcatgcgcaaccgcgcctccggcgagctcgtcgccgtcaagtacatcgaccgcggcgagaagatcgacgagaacgtgcagagggagatcatcaaccacaggtcgctgcggcaccccaacatcatccggttcaaggaggttattctgacgccgacgcatctcgccatcgtcatggagtacgcctccggcggggagctcttcgaccgcatctgcaccgccggtcgattcagcgtcgacgaggctcgcttctttttccagcaactgatatctggagttagctactgccattcaatgcaagtgtgccatcgtgacttaaagctcgagaacactctgctggatggaagcaccacccctcgcctcaagatatgcgacttcggttattccaagtcatcagttcttcattctcaaccaaagtcaactgttggaactccggcatacattgcccctgaagttctgatcaagaaagaatacgatggcaagattgccgatgtgtggtcatgtggcgtaaccctttacgtgatgttggttggcgcctaccctttcgaggatccagaaaatcccaagaatttcaaaatgacaattcagaaaatattaggcgttcagtactcgattccggactatattcacatacccatggactgccggaaccttctctcaaggatctttgttgccaacccagctacggtgagtgctcactcactccatcgacacacacacggtttcacccgttccgctctcaggaatcaggataacgcctgtgctatttgagcttgcagaggatcaccatacctgagataaagaaccacccatggttcctcaagaacctcccagctgacctcatggacggtcccacggtgagcaaccagtatgaggagcctgaccaaccgatgcagaacatgaacgagatcatgcagataatggcagaggccaccataccggcggccagcgccctcggaatcaacaagttcctgcctgacggccttgacctcgacgacgatatggatgacctggactcggacctcgatatcgacatggacagcagcggggagatagtatacgccatgtagtaaacttgtgaatatctgtatgtgcagaagcggtgtttgcgatcttccaccttgtttgtttcttgaacacgcaccagattgttgagtggcattttgtgttaagaagagtgtagaaatgtacatcgagaggtttgtattcaggctactgcttgagtctgaaattggtgttgctgctgattgtgtagcatgtgttgtctaacaaaatatgttggggtttcctgtaatctctagttgataaaagggagtattcacccgaaawyktwrgarrrmaawrctgttt

SEQ ID NO: 428 - DNA, 1545 bp, Hordeum vulgare
  misc_feature (26)..(26): n is a, c, g, or t
ggaattgacaaaagcgcgcggccagnattaggaagaaaggttcgacagcgagataaggagagagagggggcgcgcggggacctccgtgtcagtcttgggcggcggtagagtcgtcggcgcgggggcgatggagagggggacgatgggcgacgtgccggtgatgctcgacggcgaccggtacgagctggtccgcagcatcggatccggcaacttcggcgtcgcccgcctcatgcgcaaccgcgcctccggcgagctcgtcgccgtcaagtacatcgaccgcggcgagaagatcgacgagaacgtgcagagggagatcatcaaccacaggtcgctgcggcaccccaacatcatccggttcaaggaggttattctgacgccgacgcatctcgccatcgtcatggagtacgcctccggcggggagctcttcgaccgcatctgcaccgccggtcgattcagcgtcgacgaggctcgcttctttttccagcaactgatatctggagttagctactgccattcaatgcaagtgtgccatcgtgacttaaagctcgagaacactctgctggatggaagcaccacccctcgcctcaagatatgcgacttcggttattccaagtcatcagttcttcattctcaaccaaagtcaactgttggaactccggcatacattgcccctgaagttctgatcaagaaagaatacgatggcaagattgccgatgtgtggtcatgtggcgtaaccctttacgtgatgttggttggcgcctaccctttcgaggatccagaaaatcccaagaatttcaaaatgacaattcagaaaatattaggcgttcagtactcgattccggactatattcacatacccatggactgccggaaccttctctcaaggatctttgttgccaacccagctacggtgagtgctcactcactccatcgacacacacacggtttcacccgttccgctctcaggaatcaggataacgcctgtgctatttgagcttgcagaggatcaccatacctgagataaagaaccacccatggttcctcaagaacctcccagctgacctcatggacggtcccacggtgagcaaccagtatgaggagcctgaccaaccgatgcagaacatgaacgagatcatgcagataatggcagaggccaccataccggcggccagcgccctcggaatcaacaagttcctgcctgacggccttgacctcgacgacgatatggatgacctggactcggacctcgatatcgacatggacagcagcggggagatagtatacgccatgtagtaaacttgtgaatatctgtatgtgcagaagcggtgtttgcgatcttccaccttgtttgtttcttgaacacgcaccagattgttgagtggcattttgtgttaagaagagtgtagaaatgtacatcgagaggtttgtattcaggctactgcttgagtctgaaattggtgttgctgctgattgggtagcatgtgttgtctaacaaaatatgttggggtttcaagggatctctagtgataaaagggagtttccccg

SEQ ID NO: 429 - DNA, 1558 bp, Hordeum vulgare
  misc_feature (26)..(26): n is a, c, g, or t
ggaattgacaaaagcgcgcggccagnattaggaagaaaggttcgacagcgagataaggagagagagggggcgcgcggggacctccgtgtcagtcttgggcggcggtagagtcgtcggcgcgggggcgatggagagggggacgatgggcgacgtgccggtgatgctcgacggcgaccggtacgagctggtccgcagcatcggatccggcaacttcggcgtcgcccgcctcatgcgcaaccgcgcctccggcgagctcgtcgccgtcaagtacatcgaccgcggcgagaagatcgacgagaacgtgcagagggagatcatcaaccacaggtcgctgcggcaccccaacatcatccggttcaaggaggttattctgacgccgacgcatctcgccatcgtcatggagtacgcctccggcggggagctcttcgaccgcatctgcaccgccggtcgattcagcgtcgacgaggctcgcttctttttccagcaactgatatctggagttagctactgccattcaatgcaagtgtgccatcgtgacttaaagctcgagaacactctgctggatggaagcaccacccctcgcctcaagatatgcgacttcggttattccaagtcatcagttcttcattctcaaccaaagtcaactgttggaactccggcatacattgcccctgaagttctgatcaagaaagaatacgatggcaagattgccgatgtgtggtcatgtggcgtaaccctttacgtgatgttggttggcgcctaccctttcgaggatccagaaaatcccaagaatttcaaaatgacaattcagaaaatattaggcgttcagtactcgattccggactatattcacatacccatggactgccggaaccttctctcaaggatctttgttgccaacccagctacggtgagtgctcattcactccatcgacacacacacggtttcacccgttccgctctcaaggatctttgttgccaacccagctacgaggatcaccatacctgagataaagaaccacccatggttcctcaagaacctcccagctgacctcatggacggtcccacggtgagcaaccagtatgaggagcctgaccaaccgatgcagaacatgaacgagatcatgcagataatggcagaggccaccataccggcggccagcgccctcggaatcaacaagttcctgcctgacggccttgacctcgacgacgatatggatgacctggactcggacctcgatatcgacatggacagcagcggggagatagtatacgccatgtagtaaacttgtgaatatctgtatgtgcagaagcggtgtttgcgatcttccaccttgtttgtttcttgaacacgcaccagattgttgagtggcattttgtgttaagaagagtgtagaaatgtacatcgagaggtttgtattcaggctactgcttgagtctgaaattggtgttgctgctgattgtgtagcatgtgttgtctaacaaaatatgttggggtttcctgtaatctctagttgataaaagggagtattcacccgaaaatttaagaaaaaaaaac

SEQ ID NO: 430 - DNA, 1671 bp, Hordeum vulgare
tagtgagtgagagagggagagggagagatcacgaggcggggcttctcctccgcccaatccgttccaccaccctccccccctctggagctggagctggagctcatcatcagctaattaaactaaaggcagcaggccaaggcttctttctctcttggatcgcggggtcacgggaggcgcgcgcgcgggagcttgcttgctcgctcgatcgaccgacctcgcggcggtgggggaagggaagggaaggggaagggggatggaccgggcggcgctgacggtggggccggggatggacatgcccataatgcacgacggcgaccggtacgagctcgtcaaggacatcggctccggcaacttcggcgtcgcgcgcctcatgcgcaaccgcgccgacggccagctcgtcgccgtcaagtacatcgagcgaggggagaagattgacgagaacgtgcagcgggagatcatcaaccaccggtcgctgcgccaccccaacatcatccgcttcaaggaggtcatcctcacgcccacgcacctcgccatcgtcatggagtacgcctccggcggggagctcttcgagcgcatctgcaacgccggcaggttcagcgaggacgaggcgcgtttctttttccagcagctgctctcaggggtcagctactgccactccatgcaagtatgccatcgtgacctgaagctggagaacaccctgctggacgggagcacggctccccgcctcaagatatgcgactttggatattccaagtcgtcggttcttcactcgcagcctaaatcaaccgtcggaacccccgcatacattgctcctgaggttcttctcaagaaggaatatgatggaaagattgcggatgtgtggtcgtgtggagtgacgctttatgttatgctagttggtgcatatccctttgaggacccggatgagcccaagaattttaggaagacaattcagaggatattgagcgtgcagtactcgattcccgattacgtgcacatatcttccgagtgtcgagatcttattgccaagattttcgtcggcaacccagctaccagaatcacaatccccgagataagaaaccatccgtggttcttgaagaacctcccagctgacctggtggatgatagcaccatgagcagccagtacgaggagcctgaacagccgatgcagagcatggacgagatcatgcagatcctggcggaggccaccatcccggcggctggttctcggatcaaccagttcttgaacgacggtctcgaccttgacgacgacatggacgaccttgattcggacgccgacctcgacgtggaaagcagcggggagatcgtatatgccatgtgacactgcaaaggctctcacatataagttgaccgaaagatggccaagatactcgaggaagggatagatatcttgaggctaccgctgaagttcggctgctcatgcttgatagcccacaaatgttactttgttgttgtttttgttgttggtccctgtacttccgatgttctgaaacggtttagcctgccttttggatgtaaccatgctttgctctaatgccgtgtgactatctccgctaatttgggaactgaccgtgtctgtgctccccttagataagggacatgttatcacatcatgtttgtaccatgtatatgtgttgtaggcaaataaagggc

SEQ ID NO: 431 - DNA, 1704 bp, Hordeum vulgare
  misc_feature (1698)..(1698): n is a, c, g, or t
taataagacgggcgagagagtgattgagcgggcgttttatctctctctctctcttggtcggccagtgtcacgaactcgtcgcggcggagggggggagaggggggctgagctcgccgtcgattcgagggggcgggaggagaggggcggccaccccggcggaccgaaccctagcggccgcggcctcctccattcgagcgccgccgtcgccgccggccatggctggggcggcgccggatcgggcggcgctgacggtcggcccgggcatggacatgccgatcatgcacgacagcgaccgctacgagctggtgcgggacatcggctccggcaacttcggcgtcgcccgcctcatgcgcgaccgccgcaccatggagctcgtcgccgtcaagtacatcgagcgcggggagaagatagacgagaatgtccagcgtgagataattaaccatagatcactgaaacatcccaacatcattaggtttaaggaggttattttaacaccgactcatcttgctattgtcatggaatatgcatctggtggtgagctttttgagaggatatgtaaaaatatacgattcagtgaagacgaggctcgctacttcttccagcagcttatatctggagtcagctactgccattcaatgcaagtatgtcaccgtgacttgaagctggagaacacattgctagacggtagtcctgctcctcgcttgaagatatgtgatttcggctattctaagtcttcagttctccattcacaaccaaaatcaactgtaggaacacccgcttatattgcacctgaagttctcttgaagaaagaatatgatggcaagattgctgatgtatggtcctgtggtgtgactctttatgtcatggtagtcggtgcgtatccttttgaggatccagaagagcctaagaacttccggaagacaattcagcgtatcttgagtgttcagtattcaattccagataacgtggacatatctccagagtgcaggcacctaatttcgaggatttttgttggggatcctgctttgaggataaccatccctgaaatacggagccataattggttcttaaagaacctccccgccgatctgatggacgatgatagtatgagcagccagtacgaggagcccgaacagccaatgcagacgatggaccagatcatgcaaattctgacggaggccaccataccacccgcttgttctcgtataaaccacatcctaactgatgggttcgacatggacgatgacatggatgaccttgaatcggactcagatctcgatatcgacagcagtggagagatcgtgtatgcgatgtgagccatctccagcggctatcgcgtcgaagcgaccgtagaaagcagctgaaaggtgacctgatgctgtaccctgtcaaaagagctagcagcacttcgttctgtgtttcgcaagcgaagtccccgtcctgttctggttgtaatataatgggggttagtccctggagaagcatcttttctgttcctgttgtgctacatatgtacaagtagctcgtactcctgttaatgtctgaacctgtgactcaacttcgttttattttatttgtgttactgtatatctagtgacctgttgtttgggctactttgccagaaaaatgcagggaaattcgatctaaaataaataaatacaggagaagtaaataaccgtttttggcgaccggcggctnggaaaa

SEQ ID NO: 432 - DNA, 1707 bp, Hordeum vulgare
  misc_feature (1698)..(1698): n is a, c, g, or t
taataagacgggcgagagagtgattgagcgggcgttttatctctctctctctcttggtcggccagtgtcacgaactcgtcgcggcggagggggggagaggggggctgagctcgccgtcgattcgagggggcgggaggagaggggcggccaccccggcggaccgaaccctagcggccgcggcctcctccattcgagcgccgccgtcgccgccggccatggctggggcggcgccggatcgggcggcgctgacggtcggcccgggcatggacatgccgatcatgcacgacagcgaccgctacgagctggtgcgggacatcggctccggcaacttcggcgtcgcccgcctcatgcgcgaccgccgcaccatggagctcgtcgccgtcaagtacatcgagcgcggggagaagatagacgagaatgtccagcgtgagataattaaccatagatcactgaaacatcccaacatcattaggtttaaggaggttattttaacaccgactcatcttgctattgtcatggaatatgcatctggtggtgagctttttgagaggatatgtaaaaatatacgattcagtgaagacgaggctcgctacttcttccagcagcttatatctggagtcagctactgccattcaatgcaagtatgtcaccgtgacttgaagctggagaacacattgctagacggtagtcctgctcctcgcttgaagatatgtgatttcggctattctaagtcttcagttctccattcacaaccaaaatcaactgtaggaacacccgcttatattgcacctgaagttctcttgaagaaagaatatgatggcaagattgctgatgtatggtcctgtggtgtgactctttatgtcatggtagtcggtgcgtatccttttgaggatccagaagagcctaagaacttccggaagacaattcagcgtatcttgagtgttcagtattcaattccagataacgtggacatatctccagagtgcaggcacctaatttcgaggatttttgttggggatcctgctttgaggataaccatccctgaaatacggagccataattggttcttaaagaacctccccgccgatctgatggacgatgatagtatgagcagccagtacgaggagcccgaacagccaatgcagacgatggaccagatcatgcaaattctgacggaggccaccataccacccgcttgttctcgtataaaccacatcctaactgatgggttcgacatggacgatgacatggatgaccttgaatcggactcagatctcgatatcgacagcagtggagagatcgtgtatgcgatgtgagccatctccagcggctatcgcgtcgaagcgaccgtagaaagcagctgaaaggtgacctgatgctgtaccctgtcaaaagagctagcagcacttcgttctgtgtttcgcaagcgaagtccccgtcctgttctggttgtaatataatgggggttagtccctggagaagcatcttttctgttcctgttgtgctacatatgtacaagtagctcgtactcctgttaatgtctgaacctgtgactcaacttcgttttattttatttgtgttactgtatatctagtgacctgttgtttgggctactttgccagaaaaatgcagggaaattcgatctaaaataaataaatacaggagaagtaaataaccgtgtttggcgaccggcggctnggaaaaagc

SEQ ID NO: 433 - DNA, 1580 bp, Gossypium sp.
gacagaagcaataaaaaacctaaaccatcaatgtcaaaatacagatgaacagattgagctgtgaaagtgggagagagatcatgagaatcttcttctaatcatcctcccttctaaactagtattaaatatcgattcattcgaccgactcgcataacagactcaaatcgaaactagcatcgtggacttccatattatagttttaatctctgataccaggcactcgggaatacattctctgcagccatgtctttatcacctctcaatatgatgacccaaactgttttcttcctattacattgcatagattatctccccgctgctgtcgatgtcgagctcggattcagaatcaagggcatccatgtcttcatcatcaaggatgtctgacatgtgacttaggtcacgggcacccgctgctggaatggtggcctcggcaattatctgcctgatcgtatccatgctctgcataggttgatcaggctcctcaaagtggttacccattgtgttttcatccatcagatcagcaggtagattcttcaagaaccactcgtgatttctgatttccggaatcgtaatcctagctgtaggatcagcaacaaaaatccttgaaatcagatgtcgacattcgggagatatttggacaaaatctggaatggagtactggacactgagaattcttgtatcgtcttccgaaagtcttttggctcatcaggatcctcgaaaaggatatgccccgaccagcattacatacaaggtaaccccgcatgaccatacatctgcaatcttgccatcgtattcttgcctttggagtacctcgggggcaatgtatgcaggagttccaacagtggacttcggttgcgaatgaagaactgaagactttgaatacccaaaatcgcatatcttaagccgaggagctggacttccatccaacaaagtgttttccaacttcaaatcacggtggcatacttgcattgcatgacaataactaacaccggataaaagttgttggaagaagaagcgagcctcatcctcgttgaatcgaccagcagcacaaattctctcgaaaagctcacctcccgatgcatattccattacgatggcaagatgagtaggtgttaaaataacctctttaaatctaacaatattaggatgcctcaatgatctatgattaataatctctcttcgaacattttcatctatcttatcgcctctctcgatgtacttaacagcaacgagctctctggtaatcttatccctcataagccgggcgactccgaaattacccgacccgatatctttaacgaaatcgtatcgatcactgtcgtgcatgatcggcatatccatacccggccctaccatcatgtctgcccgatccatttttctctctttttttaagtttcttgaatcttatcacttgaaaaagaaaacaaactcacgaagcatcaccgatatcaaaccgcaccacttgactcggttttgtagatagagaccactgagttaaacaagtcggttaataaaaaagaaagcgtttttttattaggacggcgtttaaaagagggttctgccagtgccacagtgaagag

SEQ ID NO: 434 - DNA, 1569 bp, Gossypium sp.
ctcttatcaatcgccgatcaactaataacccttccttcccttcttcttcttcttgttgttattattaaccgactcgtttaactcagtgattcgtccaagaagccactgagtccggtgatgtggtcctgagttctttctttgaagggggtagaatcagaaactgaaaaaaagagagacaaaaatggatcgagcagacttgacggtcggaccggctatggatatgccgattatgcacgacagtgaccgttacgatttcgttagagatatcggatctggtaatttcggagttgctcgacttatgagagataaggttaccaaggagctcgtcgctgtcaagtacatcgaaagaggccgtaagatagatgaaaatgttcaaagagaaattattaatcatagatcattgaggcatccgaatattgttagatttaaagaggttattttaacacctactcatcttgccattgtaatggagtatgcctccggaggtgagcttttcgagcggatttgtgctgcgggtcggttcaatgaggacgaggctcggttcttcttccaacagcttatatccggcgttagttattgccatgcgatgcaagtatgccatcgtgatttaaagttggaaaacactttgctagatggaagtccagctcctcggcttaagatatgtgattttgggtactcgaagtcttcagttcttcattcgcaaccaaaatccacagttggaactcctgcatacattgctcctgaagtactcctaaggaaagaatatgatggcaagattgcagatgtttggtcatgcgggggtaccttgtatgtcatgctggttggagcatacccttttgaggatccagatgagccaagagactttcggaaaacaatacaaagaattcttagtgtccagtatgccattcctgatgtcatccaaatatcacctgagtgtcaacatctgatttcaaggatatttgttgctgatccttcagctagaattacaattcctgaaattagaaaccacgagtggttcttgaagaatctccctgctgacctgatggacgaaaacacaatgggtagccacttcgaggagcccgatcaacctatgcagagcacagatacaatcatgcagataatagctgaggccaccattccagctgctggagcccctggcttaaaccattacatagtcgacaaccttgatgatgaagacatggatgaccttgattctgaaatcggagcttgatgttgatagtagtggggaggatagactatgcaatgtgatatgaaggaagagaggctatatgaaatggtgcaattgttccaagcaaataaaagtgggaaaacatatagatgaaaagaattatagggaaaaagggacaaaactggagtaagaagtggatggagcgttgagtgcttgtggtggtagggtggagctgtgatacaaagtgggggaagaaaatgaggttcgtgctgggtggcagggggggagtgacaagggggaaggggggagtgaggggtggatgggatggcgagtgggcaggagcgggagtcgggggtggaaccggggggagatggatagag

SEQ ID NO: 435 - DNA, 1958 bp, Gossypium sp.
aatagaaagtagccatatattatatatattcaactgcataaaacagaaccaagcaaaaagtacacgagcaatgccaaaatacaaatgaaccgggttcgatgatggttaccgggatgttgaagtttgggagatgatcatccgacattgaaccttttatccctgtggatcatcccttgtaaagtagtattaaatatcaatttcttccacagatttgtataaaagcttcatgctatgaacataatggactcaatggaccatgacaatttcagaccagtattgcgcaactctaccataaattctttgcagctatatgtcttcacacttttgattgcctggaacaactgcaccattgcagagaagctctcttccttcatatcacattgcatagactatctccccactactatcaacatcaagctccgattcagaatcaaggtcatccatgtcttcatcatcaaggttgtcgactatgtaatggtttaagccaggggctccagcagctggaatggtggcctcagctattatctgcatgattgtatctgtgctctgcataggttgatcgggctcctcgaagtggctacccattgtgttttcgtccatcaggtcagcagggagattcttcaagaaccactcgtggtttctaatatcaggaattgtaattctctgttacataaaataatccatcatcagaatggcttaatcacttcagaatcatgttagttttcaaaagttaccacaaaatgcaaaaaaaaaaggccactcctccttccctttcctggacgttcgtgtaccaaaatcagaagttagctttcaaaaatcaaggaacaaaatttcaaagttgaagcaagcagaaattactcacagctgaaggatcagcaacaaatatccttgaaatcagatgttgacactcaggtgatatttggacgacatcaggaatggcatactggacactaagaattctttgtattgttttccgaaagtctcttggctcatctggatcctcaaaagggtatgctccaaccagcatgacatacaaggtaaccccgcatgaccaaacatctgcaatcttgccatcatattctttccttaggagtacttcaggagcaatgtatgcaggagttccaactgtggattttgggtgcgaatgaagaactgaagacttcgagtacccaaaatcacatatcttaagccgaggagctggacttccatctagcaaagtgttttccaactttaaatcacgatggcatacttgcatcgcatggcaataactaacgccggatataagctgttggaagaagaaccgagcctgcaccaaaataacggatatatacaagttaaagacaaaacaaaagggggacataaaattgaatgctaaatataagaaaataaacctcgtcctcattgaaccgacccgcagcacaaatccgctcgaaaagctcacctccggaggcatactccattacaatggcaagatgagtaggtgttaaaataacctctttaaatctaacaatattcggatgcctcaatgatctatgattaataatttctctttgaacattttcatctatcttacggcctctttcgatgtacttgacagcgacgagctccttggtaaccttatctctcataagtcgagcaactccgaaattaccagatccgatatctctaacgaaatcgtaacggtcactgtcgtgcataatcggcatatccatagccggtccgaccgtcaagtctgctcgatccatttttgtctctctttttttcagtttctgattctacccccttcaaagaaagaactcaggaccacatcaccggactcagtggcttcttggacgaatcactgagttaaacgagtcggttaataataacaacaagaagaagaagaagggaaggaaaggttattagttgatcggcgattgataagagtggttcagggaggagcggagcttttggggaag

SEQ ID NO: 436 - DNA, 2038 bp, Gossypium sp.
ccattgtaaatctgtcttttaatagatctaaaatagtgctaaatccgtgtaaaaacttaaaaagttaacatataatakwaagtagccatatattatatatattcaactgcataaaacagaaccaagcaaaaagtacacgagcaatgccaaaatacaaatgaaccgggttcgatgatggttaccgggatgttgaagtttgggagatgatcatccgacattgaaccttttatccctgtggatcatcccttgtaaagtagtattaaatatcaatttcttccacagatttgtataaaagcttcatgctatgaacataatggactcaatggaccatgacaatttcagaccagtattgcgcaactctaccataaattctttgcagctatatgtcttcmcacttttgattgcctggaacaactgcaccattgcagagaagctctcttccttcatatcacattgcatagactatctccccactactatcaacatcaagctccgattcagaatcaaggtcatccatgtcttcatcatcaaggttgtcgactatgtaatggtttaagccaggggctccagcagctggaatggtggcctcagctattatctgcatgattgtatctgtgctctgcataggttgatcaggctcctcgaagtggctacccattgtgttttcgtccatcaggtcagcagggagattcttcaagaaccactcgtggtttctaatttcaggaattgtaattctctgttacataaaataatccatcatcagaatggcttaatcacttcagaatcatgttagttttcaaaagttaccacaaaatgcaaaaaaaaaaggccactcctccttccctttcctggacgttcgtgtaccaaaatcagaagttagctttcaaaaatcaaggaammaaatttcaaagttgaagcaagcagaaattactcacagctgaaggatcagcaacaaatatccttgaaatcagatgttgacactcaggtgatatttggacgacatcaggaatggcatactggacactaagaattcttgtatygttttccgaaagtctcttggctcatctggatcctcaaaaggrtatgctccraccagcatgacatacaaggtaaccccgcatgaccatacatctgcaatcttgccatcatattctttccttaggagtacttcaggagcaatgtatgcaggagttccaactgtggattttggttgcgaatgaagaactgaagacttcgagtacccaaaatcacatatcttaagccgaggagctggacttccatctagcaaagtgttttccaactttaaatcacgrtggcatacttgcatygcatggcaataactaacgccggatataagctgttggaagaagaaccgagcctcgtcctcattgaaccgacccgcagcacaaatccgctcgaaaagctcacctccggaggcatactccattacaatggcaagatgagtaggtgttaaaataacctctttaaatctaacaatattaggatgcctcaatgatctatgattaataatctctcttcgaacattttcatctatcttacggcctctttcgatgtacttgacagcgacgagctccttggtaaccttatctctcataagtcgagcaactccgaaattaccagatccgatatctctaacgaaatcgtaacggtcactgtcgtgcataatcggcatatccatagccggtccgaccgtcaagtctgctcgatccatttttgtctctctttttttcagtttctgattctacccccttcaaagaaagaactcaggaccacatcaccggactcagtggcttcttggacgaatcactgagttaaacgagtcggttaataataacaacaagaagaagaagaagggaaggaaaggttattagttgatcggcgattgataagagtggttcagggaggagcggagcttttggggaagaggaaggggggataatgccaaggaaatatctggtagargcagaggaggataagaggagtacggcgtcgyywsgmggyygttgcggacgcgtgg

SEQ ID NO: 437 - DNA, 1997 bp, Zea mays
ccctcgaggccggccggggcagccctatcgtcgtcttcggttcgtctcttctgttgctgggctcgtcgcgagggtagcakwggsyasmtgagggacagagcgaagagagagaaactgaagaaacaacattttccgtttttcttgcttagtgaaaccagtggaagagggagagaaaagaagacgaagacgacaatataagtaaataaaaaaaaggcagcgagcgaggtggggaaaaaggggcgagttgatagagagaaagatagagagagaaggcgagggaggcagggatcacgaggtgtgcttcctcctccgcccaatcctgcccaaccaaatccgccagcgccgcctcctttacactcccacctctgtcccggagcttcttggatcacgggacgcgcgccgcgggccggtacgctgctggtgctggaccgctcgactctcgcctaccagctgctgctttggctggcgcgccggcgagagagagagagagagagggacgcgacggcgatggaccgggcggcgctcaccgtgggcccggggatggacatgcccataatgcacgacggcgaccgctacgagctcgtccgcgacatcggctccggcaacttcggcgtcgcgcgcctcatgcgcaaccgcgccgacggccagctcgtcgccgtcaagtacatcgaccgaggcgagaagattgacgagaacgtgcagcgggagatcatcaaccaccgctcgctgcgccaccccaacatcatccgcttcaaggaggtcatcctcaccccgacgcacctggccatcgtcatggagtacgcctccggcggggagctcttcgagcgcatctgcaacgccggcagattcagcgaggacgaggcgcgtttctttttccagcaactcatatcaggggtcagctactgccattccatgcaagtatgccatcgcgacttgaagctagagaacaccctgttggacgggagcaccgcgcctcgcctcaagatatgtgattttggctactcaaagtcatcagttctacactcgcagccgaaatctacagtgggaactcctgcatacattgctcctgaggttcttctgaagaaggaatacgatggraaggttgctgatgtgtggtcatgtggagtaacgctctacgtgatgctggtcggcgcgtatccattcgaggacccagacgagcctaagaatttcaggaagacgatccagcagagaatactgggcgtgcagtactcggttccagactacgtccacatatctccggaatgccaggacctaatctccaggatcttcgtcgccaacccgtccaccaggatcaccatgcccgagatacggagccacccttggttcctgaagaacctcccggccgacctggtggacgacagcgcgacgacgacgagcaagcagtacgaggagcccgagcagccgatgcagggcatggacgagatcatgcagatcctgggcgaggccaccattccggcggcggggtcccgcgggctcaaccagttcctgaacgacggcctggacctcgacgacgacatggaggacctggactcggacgccgacctcgacctggagagcagcggggagatcgtgtacgctatgtgacggcgccgagtgctcagcgacgaggcaatgtctcgttgcgctcgcaggttgccgagataactagagagacggagagggtgggtgtgtgctgctgctgcctgcagcctgcgtgtagttgtgtgctttcaggtctctgctgctcatgcctgatgccgtcgttcgtgatggcccctttttaccgtcctgttgtgtttggccgttgttatttggtgcgccttcagtgcagtgttttgcaacggtttagccatttggaatcgctactgctacaacctcgttcatccgagaggaccctttgtttctgcatccccagcgatgtacttgtattactacactgtatcatatgttatatttggtgtaggaaaataaaggaactccattgcccgttctctgtc

SEQ ID NO: 438 - DNA, 1682 bp, Zea mays
gagcaagctcttcggcgatttgagaagaatcgacgagcaagcgagcgagcgagcgagagaggaggaggaggagctggggcttgagcctgcgcccgggggccccggctcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgatatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaagcaccctaacattattaggtttaaagaggttattttaacaccgacccatcttgctattgtcatggaatatgcctctggcggtgagctttttgagaggatatgtaagaacgtgcgattcagtgaagatgaggctcgctacttcttccagcagcttatttcaggagtaagctactgccattcaatgcaagtatgccaccgtgatttgaagttggagaacacacttctagatgggagtgacgctcctcgcttgaagatttgcgatttcggttattccaagtcatctgttcttcattcccagccgaagtccactgttggaacacctgcttatattgcacctgaagttttgttgaaaaaagaatatgatggcaagattgctgacgtttggtcatgtggtgtaaccctctatgtaatggttgttggcgcatatccttttgaagatccagaagagcctaagaacttccgcaagacaattcagcgtatcttgaatgttcagtacgcaattccagacaacgtgaacatatctccagagtgcaggcatctaatttcgaggatttttgttggcgatcctgctacgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggatgacgacatggatgatcttgattccgactcagatcttgatgttgacagcagcggtgagattgtgtacgcaatgtgagtaacatctcagcagccatctcagcagtcaaccaaggaaccaatcaggcatgggatgccctgttgtatactctggcaaagggcatgcttccttttgtgaaaaacatccatgtagttttctcaaggaatcgcaatgtgttctgtggaacacatatgttgtagtcaaactcgggttactcagcttgtaaaactagcctcctcttgcttcctggttactgggctttggatactctcaggcttcgacttgtgtgttgctgttaaatatgtataagaaacttctactcaggttgatctgtgaatctggattccggtagtggttttgctcagtgttgggtgtattcccgatttctgcatttcaaactctgatgattaggtcttgtatttaggcgggttctggatttcaaaatttgttgttttttttg

SEQ ID NO: 439 - DNA, 1894 bp, Zea mays
aaaaaaaaaacaaaaaaaaaaaaaaaaaaaaaaatataaaaaaaaaaaaaaacggaggagggggtgggacattgggtacctcgaggctcgaggggagtggcgtcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaagcaccctaacattattaggtttaaagaggttattttaacaccgacccatcttgctattgtcatggaatatgcctctggcggtgagctttttgagaggatatgtaagaacgtgcgattcagtgaagatgaggctcgctacttcttccagcagcttatttcaggagtaagctactgccattcaatgcaagtatgccaccgtgatttgaagttggagaacacacttctagatgggagtgacgctcctcgcttgaagatttgcgatttcggttattccaagtcatctgttcttcattcccagccgaagtccactgttggaacacctgcttatattgcacctgaagttttgttgaaaaaagaatatgatggcaagattgctgacgtttggtcatgtggtgtaaccctctatgtaatggttgttggcgcatatccttttgaagatccagaagagcctaagaacttccgcaagacaattcagcgtatcttgaatgttcagtacgcaattccagacaacgtgaacatatctccagagtgcaggcatctaatttcgaggatttttgttggcgatcctgctacgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggacgacgacatggatgatcttgattccgactcagatcttgatgttgacagcagcggtgagattgtgtacgcaatgtgagtaacatctcagcagccatctcagcagtcaaccaaggaaccaatcaggcatgggatgccctgttgtatactctggcaaagggcatgcttccttttgtgaaaaacatccatgtagttttctcaaggaatcgcaatgtgttctgtggaacacatatgttgtagtcaaactcgggttactcagcttgtaaaactagcctcctcttgcttcctggttactgggctttggatactctcaggcttcgacttgtgtgttgctgttaaatatgtataagaaacttctactcaggttgatctgtgaatctggattcgggtagtggttttgctcagtgttgggtgtattcccgatttctgcatttcaaactctgatgattaggtcttgtatttaggcggkttctggatttcaaaatttgtgttttttttgtgcactgtctggttacctcctatatgaggaaagcttctcctcaccgatggatttgtttacgacaaacagaattgctgacg

SEQ ID NO: 440 - DNA, 1569 bp, Zea mays
gagagagcaagctcttcggcgatttgagaagaatcgaggagcgagcgagcgagcgagcgagagaggaggaggaggagctggggcttgagcctgcgcccggggcccccggatcacggaatcctacccttaccaaccctagcctccattggtcgccgtctcgggccatggcagggccggcgccggatcgggccgccctgactgtgggtccgggcatggacatgccgatcatgcacgacagcgaccggtacgagctcgtgcgcgacatcggctccggcaacttcggcgttgcccgcctcatgcgcgaccgccgcaccaccgaactcgtcgccgtcaagtacatcgagcgtggcgagaagatagatgagaatgtccagcgcgaaataattaaccatagatcattgaaacaccctaacattattaggtttaaagaggttattttaacaccgacccatcttgctattgtcatggaatatgcctctggcggtgagctttttgagagaatatgtaagaacgtgcgattcagtgaagatgaggctcgctacttcttccaacaactcatttcaggagtaagctactgccattcaatgcaagtatgccaccgtgatttgaagctggagaacacacttctagatgggagtgatgctcctcgcttgaagatatgtgacttcggttattccaagtcatctgttcttcattcccaaccgaagtcaactgttggaacacctgcttatattgcacctgaagttctgttgaaaaaagaatatgatggcaagattgctgatgtttggtcatgtggtgtaaccctctatgtaatggctgttggtgcatatccttttgaagacccagaagagcctaagaacttccgcaagacaattcagcgcatcttgaacgttcagtacgccattccagactacgtgaacatatctccagagtgcaggcatctaatttcgaggatttttgttggtgatcctgctatgcgaataacaatcactgaaatccggaatcatagttggttcctgaagaaccttcctgctgatcttatggatgatgatagcatgagcaaccaatatgaggagcctgatcagccaatgcagaccatggatcagatcatgcagattttaacagaggccaccataccacctgcctgttctcgcagtataaatgttctagctgatggactggacatggacgacgacatggatgatcttgactccgattcggatcttgatgttgacagcagcggtgagattgtatacgcaatgtgagtaacatctcagtaaccatctcagtatctcaccagtcaaccaaagaaccaatcaggcatgggacaccctgatgttgtacactctgccaaagacctagcatccttttgtaaaatatctccctgtagttttctcaaagaagcgcaagcccaacctgttctggggaacacggatgctgtagtcaaactggggttattcagattgtaaaactggcctcttgcttcctgcttactctcaggcttcgacttgtgtgttgctgttgaatatgtacttacaagaaacttctacggagtactcatgttgatct

SEQ ID NO: 441 - DNA, 1677 bp, Populus spp
ggcacgaggcctcgtgccgaattcggcacgaggtttatatctctgcaactcccattctctaataactataataattgaaaaacccataaagggctggtgaggtttccacgtgttttttggttaaaaatccaatctttcggtccacgtatagttctatttcgatctctctcgaaagggttttctctagtgatgctgataatgtgagttattttgattgagccctcttttcttcttcttcttcttgtggattcttgttttttttacagatatatttgaagtagatagttagaaggagaaatggatagatcagtgatgacagtggggccgggaatggacatgccgatcatgcacgatggagaccggtatgagttagtgagagatattgggtcagggaatttcggggtcgccaggttgatgagggacaaacaggctgatggacttgttgctgttaagtatatcgagagaggtgagaagatagatgaaaatgtgcaaagggaaatcattaaccacaggtcgcttaggcatcccaacatcgtcagattcaaagaggtcatattaaccccaactcatttggcgattgtaatggaatatgcgtctggtggagagctctttgagcgcatatgcaattctggtcgcttcagcgaggatgaggcacgctttttctttcaacaacttatatcaggagttagctactgccatgcaatgcaagtgtgccatcgtgacttgaaattggagaatactttgttggatggaagcccggctcctcgtctgaagatttgtgattttggttactctaagtcatcagtgctgcactctcaaccaacatctactgttggaactcctgcttatattgctcctgaagtgttacttaagaaggaatacgatggcaagattgcagacgtatggtcttgtggagtaactttatatgttatgttggttggggcttacccttttgaggaccctgatgaacctaggaattttcgcaggacaatccaccgaattttgaatgtccagtattcaatccctgactatgttcatatatctcctgaatgccaacatctaatctcgagaatttttgtagctgatcctgcaaagaggataaccattcccgagatcaggaatcatgactggtttctaaagaatttcccagcagatctcatggtggaaaataatatgaataaccagtttgaagaacccgatcaaccaatgcagagcattgatgagataatgcaaataataaccgaagccaccatacctgcagctggcacccctagtctcaaccaatatttgactggcagcttggacattgatgatgaaatggaggaggacctagacagtgatccggagcttgaccttgatagcagtggagagatagtatatgcaatgtgaatgcctaccgatgaaggattatctagaatgccttactggttggctgtggaagtgaaagtgactgtaagagagcggggggcaaagtttctatatggtggaggatttgagggtaaggaatttgtaatatctgctgaaaaaatcccatctgcatggcaggtgtcccgttatgttagcaccttctgttcttctgtgatgtgttctcacaccttcaagtggcatataatatactgtccgtgtactctttgtaaaactttcatgtaataaagttttacatcttatcttgaacca

SEQ ID NO: 442 - DNA, 1765 bp, Populus spp
aactttatcacgagctctctctctatatatctccctttattttatatctctgcaactcccattctctartaamaataataattgaaaaacccataaagggctggtgaggtttccacgtgttttttggttaaaaatccaatctttcggtccacgtatagttctatttcgatctctctcgaaagggttttctctagtgatgctgataatgtgagttattttgattgagccctcttttcttcttcttcttcttgtggattcttgttttttttacagatatatttgaagtagatagttagaaggagaaatggatagatcagtgatgacagtggggccgggaatggacatgccgatcatgcacgatggagaccggtatgagttagtgagagatattgggtcagggaatttcggggtcgccaggttgatgagggacaaacaggctgatggacttgttgctgttaagtatatcgagagaggtgagaagatagatgaaaatgtgcaaagggaaatcattaaccacaggtcgcttaggcatcccaacatcgtcagattcaaagaggtctgtcaattccttcttatcatttcttttcttttcaaagaggtactttttattcattaactccatgacacaactataggtcatattaaccccaactcatttggcgattgtaatggaatatgcgtctggtggagagctctttgagcgcatatgcaattctggtcgcttcagcgaggatgaggcacgctttttctttcaacaacttatatcaggagttagctactgccatgcaatgcaagtgtgccatcgtgacttgaaattggagaatactttgttggatggaagcccggctcctcgtctgaagatttgtgattttggttactctaagtcatcagtgctgcactctcaaccaacatctactgttggaactcctgcttatattgctcctgaagtgttacttaagaaggaatacgatggcaagattgcagacgtatggtcttgtggagtaactttatatgttatgttggttggggcttacccttttgaggaccctgatgaacctaggaattttcgcagtacaatccaccgaattttgaatgtccagtattcaatccctgactatgttcatatatctcctgaatgccaacatctaatctcgagaatttttgtagctgatcctgcaaagaggataaccattcccgagatcaggaatcatgactggtttctaaagaatctcccagcagatctcatggtggaaaataatatgaataaccagtttgaagaacccgatcaaccaatgcagagcattgatgagataatgcaaataataaccgaagccaccatacctgcagctggcacccctagtctcaaccaatatttgactggcagcttggacattgatgatgaaatggaggaggacctagacagtgatccggagcttgaccttgatagcagtggagagatagtatatgcaatgtgaatgcctaccgatgaaggattatctagaatgccttactggttggctgtggaagtgaaagtgactgtaaragagcggggggcaaagtttctatatatggtggaggatttgagggtaaggaatttgtaatatctgctgaaaaaatcccatctgcatggcaggtgtcccgttatgttagcaccttctgttcttctgtgatgtgttctcacaccttcaagtggcatataatatactgtccgtgtactctttgtaaaactttcatgtaataaagttttacatcttatcttgaacca

SEQ ID NO: 443 - DNA, 2326 bp, Oryza sativa
ggcgggagcaaaaggagaaaaaaaaacaacagcgagaaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcgatggagagggcggcggcggggccgctggggatggagatgccgataatgcacgacggtgacaggtacgagctggtgaaggagatcgggtcggggaacttcggcgtcgcccgcctcatgcgcaaccgcgcctccggcgacctcgtcgccgtcaagtacatcgaccgcggcgagaagattgacgagaacgtgcagagggagatcatcaaccacaggtcgctgcgccaccccaacatcatccgattcaaggaggttattctgacgccgacgcatctcgcgatcgtcatggagtacgcctccggcggcgagctcttcgagcgcatctgcagcgccggccgcttcagcgaggacgaggctcgtttcttcttccagcagctgatatctggagttagctactgccattccatgcaagtatgccatcgtgacttaaagctggagaacactctgctagatggaagtactgctcctcgcttgaagatatgtgactttggttactcgaagtcatcggttcttcattcacaaccaaaatcaacagttggaactccagcttatattgctccagaagttttgctcaagaaagaatacgatggaaagattgccgatgtttggtcatgcggtgtgacgctctacgtgatgttggttggcgcataccctttcgaggatcctgaagatcccaagaacttcagaaagacaattcagaaaatattgggtgttcagtactcaattccagactatgtccacatatctccggagtgccgcgatctcattacgaggatttttgttggcaacccagctagtaggatcaccatgcctgagataaagaaccacccatggttcatgaagaacatcccggctgacctcatggatgatggcatggttagcaatcagtacgaggagcctgaccagccgatgcagaatatgaacgagatcatgcagatactggcagaagcaacaattccagcagcaggcaccagtggaatcaaccagttcttgactgacagccttgacctcgacgacgacatggaggatatggactcggaccttgaccttgacattgagagcagcggagagatcgtatatgccatgtaatcatctcaacatttgcaatgaaactgcactgaaaatcagcttgtttcagagcaggtagagctccagaagagatctgtgttcaggctactaggaagcaggctctgctgcctattagttcttgagtctgaatttctgatgaaccatactgcagctgagttgcagcagattgtgtagtatgtaattatgtatgttgtgccaaaaatttagcaccggatgatatcatgcaagactgtttcttgggaacactgagaaatgagaagcattgtatggaacctagttctgtattgtattaaacagagagacagaagagatgtattggttaatgtatttgctatgtgtatgtaaatctgctttgtgccaagaagaaaaaatctctattaattctatggttctattttctcagcaagctttggctgctgctggagagtcagttgcatgaacactgaacatgtcaaaattgcagagtggattgttcctccatcctgtattagacagggaaaaatatacacatcatctgtacaaaggtgagcttggagccaaaagcatccaggaacatcagtctacaagccagtccaggttataacactcttctgctacctgaacccggaggtctgggatgacctgctcagcttccctccacagcaacgccgtctcctcgtcgcacacgacgtgcccgagggacttgagcgatgaggacgacctcgggaggctcctcagtcgcgagcattctcgcatgtcgatcttctccaggcttgttcaggtgaccgagctcctcagggaggtccgtcaggttgacacactgcgaaatgtcgaggtatttcagcctcttcaggctgcataccgaaggtgggagccgccacagagccgggcaggcgtatacccttaggatgctcaggcaatgcagcttgcccagctcatatggaagctctgtgaggtcatggcagtttgagatggagatgctctccagggaactgatttcacatatgctagatggtagctccttcaggtctatgcagtggtcaatggtg

SEQ ID NO: 444 - DNA, 1683 bp, Oryza sativa
ggcgggagcaaaaggagaaaaaaaaacaacagcgagaaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcgatggagagggcggcggcggggccgctggggatggagatgccgataatgcacgacggtgacaggtacgagctggtgaaggagatcgggtcggggaacttcggcgtcgcccgcctcatgcgcaaccgcgcctccggcgacctcgtcgccgtcaagtacatcgaccgcggcgagaagattgacgagaacgtgcagagggagatcatcaaccacaggtcgctgcgccaccccaacatcatccgattcaaggaggttattctgacgccgacgcatctcgcgatcgtcatggagtacgcctccggcggcgagctcttcgagcgcatctgcagcgccggccgcttcagcgaggacgaggctcgtttcttcttccagcagctgatatctggagttagctactgccattccatgcaagtatgccatcgtgacttaaagctggagaacactctgctagatggaagtactgctcctcgcttgaagatatgtgactttggttactcgaagtcatcggttcttcattcacaaccaaaatcaacagttggaactccagcttatattgctccagaagttttgctcaagaaagaatacgatggaaagattgccgatgtttggtcatgcggtgtgacgctctacgtgatgttggttggcgcataccctttcgaggatcctgaagatcccaagaacttcagaaagacaattcagaaaatattgggtgttcagtactcaattccagactatgtccacatatctccggagtgccgcgatctcattacgaggatttttgttggcaacccagctagtaggatcaccatgcctgagataaagaaccacccatggttcatgaagaacatcccggctgacctcatggatgatggcatggttagcaatcagtacgaggagcctgaccagccgatgcagaatatgaacgagatcatgcagatactggcagaagcaacaattccagcagcaggcaccagtggaatcaaccagttcttgactgacagccttgacctcgacgacgacatggaggatatggactcggaccttgaccttgacattgagagcagcggagagatcgtatatgccatgtaatcatctcaacatttgcaatgaaactgcactgaaaatcagcttgtttcagagcaggtagagctccagaagagatctgtgttcaggctactaggaagcaggctctgctgcctattagttcttgagtctgaatttctgatgaaccatactgcagctgagttgcagcagattgtgtagtatgtaattatgtatgttgtgccaaaaatttagcaccggatgatatcatgcaagactgtttcttgggaacactgagaaatgagaagcattgtatggaacctagttctgtattgtattaaacagagagacagaagagatgtattggttaatgtatttgctatgtgtatgtaaatatgctttgtgccaagaagaaaaaatctctattaattct

SEQ ID NO: 445 - DNA, 1741 bp, Oryza sativa
gaggagatcacgaggaggggttgctccgccgcccaatccccaaccaaaccgaatccatccgcctactagcttcttgctgctggagacgagacgaagtggtagtggagctacacctaaaaggggaggaggaggaggagcgagagcttgattcacgggaggttgccgtgtcgggcgcgcgcgggtgattgatttcgccggcggcgaggggagggagggaggcaaaagagatggaccgggcggcgctgacggtggggccggggatggacatgccgataatgcacgacggcgaccggtacgagctggtgcgggacatcggctccggcaacttcggcgtcgcgcgcctcatgcgcagccgcgccgacggccagctcgtcgccgtcaagtacatcgagcgcggcgacaagatcgacgagaacgtgcagcgggagatcatcaaccaccgctcgctgcgccaccccaacatcatccgcttcaaggaggtcatcctcacccccacccacctcgccatcgtcatggagtacgcctccggcggcgagctcttcgagcgcatctgcaacgccggcaggttcagcgaggacgaggcacggttctttttccagcaactgatttcaggagtcagctattgccattccatgcaagtatgccatcgtgacctgaagctggagaacaccctgctcgacggcagcacggcgcctcgcctcaagatatgcgactttggctattcaaagtcgtctgttcttcattcgcaaccaaaatctactgttggaactccggcatacatcgctcctgaggttctgctgaagaaggaatatgatggaaagattgctgatgtgtggtcgtgtggagtaaccctctacgtaatgctggttggtgcatatccttttgaggatccagatgagcctaagaatttcaggaagacaattcagagaatattgggtgtgcagtactctattccagattatgtccacatatctccagagtgccgagatcttattgcgaggatttttgtggccaacccagccactagaatctctatccccgagatcagaaatcatccatggttcttgaagaatctcccagctgaccttatggatgatagcaagatgagcagccagtacgaggagcccgaacagccaatgcagagcatggatgagatcatgcagatactggcagaggcgaccataccagcagctgggtctggtggaatcaaccagttcttgaatgatggccttgacctcgatgatgacatggaggaccttgattcagaccccgatcttgacgtggaaagcagtggggagatagtatacgctatgtgatgctgtgaattctagcaagcagacaggcagattgcttgtcagttgcccgcgaattggtttgttgtattacagtcacagatgacaaagatggccaagaaactgggaagtggatacatgtgtcaagagtacatcacaaaaaagttcggttgcctatgctgtttattatgcctgatgatccctgttgtctcctgttttgtcgccgttgatttgtgtattggagtgtcctagatctcgttttgagaactgtttggaaccttgtctttgctccccttaactgagggaaagcgatgtagtggtagtagtagtagtagtagcagcgtgaagactgaataagagatgcccccagtaagctcagtacacgaacttgtttccattttcaaagcaccatctgcactgcacgtcattaattttatttatgttacttc

SEQ ID NO: 446 - DNA, 1577 bp, Oryza sativa
gtgtcgggcgcgcgcgggtgattgatttcgccggcggcgaggggagggagggaggcaaaagagatggaccgggcggcgctgacggtggggccggggatggacatgccgataatgcacgacggcgaccggtacgagctggtgcgggacatcggctccggcaacttcggcgtcgcgcgcctcatgcgcagccgcgccgacggccagctcgtcgccgtcaagtacatcgagcgcggcgacaagatcgacgagaacgtgcagcgggagatcatcaaccaccgctcgctgcgccaccccaacatcatccgcttcaaggaggtcatcctcacccccacccacctcgccatcgtcatggagtacgcctccggcggcgagctcttcgagcgcatctgcaacgccggcaggttcagcgaggacgaggcacggttctttttccagcaactgatttcaggagtcagctattgccattccatgcaagtatgccatcgtgacctgaagctggagaacaccctgctcgacggcagcacggcgcctcgcctcaagatatgcgactttggctattcaaagtcgtctgttcttcattcgcaaccaaaatctactgttggaactccggcatacatcgctcctgaggttctgctgaagaaggaatatgatggaaagattgctgatgtgtggtcgtgtggagtaaccctctacgtaatgctggttggtgcatatccttttgaggatccagatgagcctaagaatttcaggaagacaattcagagaatattgggtgtgcagtactctattccagattatgtccacatatctccagagtgccgagatcttattgcgaggatttttgtggccaacccagccactagaatctctatccccgagatcagaaatcatccatggttcttgaagaatctcccagctgaccttatggatgatagcaagatgagcagccagtacgaggagcccgaacagccaatgcagagcatggatgagatcatgcagatactggcagaggcgaccataccagcagctgggtctggtggaatcaaccagttcttgaatgatggccttgacctcgatgatgacatggaggaccttgattcagaccccgatcttgacgtggaaagcagtggggagatagtatacgctatgtgatgctgtgaattctagcaagcagacaggcagattgcttgtcagttgcccgcgaattggtttgttgtattacagtcacagatgacaaagatggccaagaaactgggaagtggatacatgtgtcaagagtacatcacaaaaaagttcggttgcctatgctgtttattatgcctgatgatccctgttgtctcctgttttgtcgccgttgatttgtgtattggagtgtcctagatctcgttttgagaactgtttggaaccttgtctttgctccccttaactgagggaaagcgatgtagtggtagtagtagtagtagtagcagcgtgaagactgaataagagatgcccccagtaagctcagtacacgaacttgtttccattttcaaagcaccatctgcactgcacgtcattaattttatttatgttacttc

SEQ ID NO: 447 - DNA, 1501 bp, Oryza sativa
tggggggggggggggggccccccggaggggaccccccccctcgggtggccgaggccttggaagccgcaggtaggtagaacccccttgccgtcgccggccatggcagcggcgggggccggggcgggggcgccggatcgggcggcgctgacggtgggcccggggatggacatgccgatcatgcacgacagcgaccggtacgagctcgtgcgcgacatcggctccggcaacttcggcgtcgcccgcctcatgcgcgaccgccgcaccatggagctcgtcgccgtcaagtacatcgagcgcggcgagaagatagatgataatgtccagcgtgagattataaatcaccgatcgttgaaacatcctaacattattaggtttaaggaggttattttaaccccaactcatcttgctattgtcatggaatatgcctctggtggtgagcttttcgagagaatttgtaagaatgtacggttcagtgaagatgaggctcgctacttcttccagcagcttatctcgggagtcagctactgccattcaatgcaagtatgccaccgtgatttgaagttggagaatacactgctggatggaagccctgctccacgcttgaaaatatgtgactttggctattctaagtcttcagttctccattcacaaccaaaatccactgtaggaacccctgcttatattgcacctgaagttctgttgaagaaagaatacgatggcaagactgctgatgtatggtcctgtggtgtgactctatatgttatggtagttggtgcatatcctttcgaggatccagaagagcctaagaacttccgtaaaacaattcagcgtatcttgaatgttcagtactcaattccagaaaacgtggacatatctccagaatgtaggcatctaatttcgaggatttttgtcggggatccgtctttgaggataacaatcccagaaatacggagccatggctggttcttgaagaaccttcctgcagatttgatggacgatgatagtatgagcagccagtatgaggaacctgatcagccaatgcaaaccatggatcagatcatgcaaattttaactgaggccaccataccacctgcttgctctcgaataaaccacatcctaactgatggactcgacctagacgatgacatggatgacctcgattccgactcagatattgatgttgatagcagcggcgagatcgtctatgcgatgtaagtcatcgaccaacaagagaactgaaggggcagggtgccctgatgtgtaccttgtcaaagtactagcagccctttgtgaaaagaatcgttctgtattttgcttagtttcttgccgtggaaccccagcgatgttcccatgaactcatgatgctgttgtaattgaactggggttacttccctggaataacagctttcctcctccccccattgctgaggcctggttacctttaagcttcaacacatgcgttacaaatgtgcaagttatttaatgtcagaaatttagagtc

SEQ ID NO: 448 - DNA, 1709 bp, Oryza sativa
tggtcggccagtgtcaccaccacaccaactcgtcgaggagagagaaggaggaggaggaggaggaggaggaggggaggagagctcgtcgccgattcgggcgtgggggggggggggggggcgcgcggaggggagccgccgcctcgggtggccgaggccttggaagccgcaggtaggtagaacccccttgccgtcgccggccatggcagcggcgggggccggggcgggggcgccggatcgggcggcgctgacggtgggcccggggatggacatgccgatcatgcacgacagcgaccggtacgagctcgtgcgcgacatcggctccggcaacttcggcgtcgcccgcctcatgcgcgaccgccgcaccatggagctcgtcgccgtcaagtacatcgagcgcggcgagaagatagatgataatgtccagcgtgagattataaatcaccgatcgttgaaacatcctaacattattaggtttaaggaggttattttaaccccaactcatcttgctattgtcatggaatatgcctctggtggtgagcttttcgagagaatttgtaagaatgtacggttcagtgaagatgaggctcgctacttcttccagcagcttatctcgggagtcagctactgccattcaatgcaagtatgccaccgtgatttgaagttggagaatacactgctggatggaagccctgctccacgcttgaaaatatgtgactttggctattctaagtcttcagttctccattcacaaccaaaatccactgtaggaacccctgcttatattgcacctgaagttctgttgaagaaagaatacgatggcaagactgctgatgtatggtcctgtggtgtgactctatatgttatggtagttggtgcatatcctttcgaggatccagaagagcctaagaacttccgtaaaacaattcagcgtatcttgaatgttcagtactcaattccagaaaacgtggacatatctccagaatgtaggcatctaatttcgaggatttttgtcggggatccgtctttgaggataacaatcccagaaatacggagccatggctggttcttgaagaaccttcctgcagatttgatggacgatgatagtatgagcagccagtatgaggaacctgatcagccaatgcaaaccatggatcagatcatgcaaattttaactgaggccaccataccacctgcttgctctcgaataaaccacatcctaactgatggactcgacctagacgatgacatggatgacctcgattccgactcagatattgatgttgatagcagcggcgagatcgtctatgcgatgtaagtcatcgaccaacaagagaactgaaggggcagggtgccctgatgtgtaccttgtcaaagtactagcagccctttgtgaaaagaatcgttctgtattttgcttagtttcttgccgtggaaccccagcgatgttcccatgaactcatgatgctgttgtaattgaactggggttacttccctggaataacagctttcctcctccccccattgctgaggcctggttacctttaagcttcaacacatgcgttacaaatgtgcaagttatttaatgtcagaaatttagagtcaggtttgggtttcagttttactgtacaggtggagtagccgtgaactcttgctatcacaatgcctctcggtaattcccaggggaagttaacctcaaaaaagttcttttc

SEQ ID NO: 449 - DNA, 1944 bp, Sorghum bicolor
gcacgagggaaaaaagggcgaagtgatatagagaggagagagagaaggcgaggggaggggagggatcaccaggtgtgcttcctcctccgcccaatcgggcccaaccaaatccgccagcgccgcctcctttaccacctctttccccggagctaaaaggcgagggaggggagaggctgcgcgtcgcttcttggatcgcggggcggggtcacgggacgcgcgccgcgggccggtaacgctacctgctgctgctgctggtggactgctcgcctcgacaccttgcctcctagcctaccacctcctcctcctgctgctgctgctttggctggagccggcgatggaccgggcggcgctcaccgtggggccggggatggacatgcccataatgcacgacggcgaccgctacgagctcgtacgcgacatcggctccggcaacttcggcgtcgcgcgcctcatgcgcaaccgcgccgacggacagctcgtcgccgtcaagtacatcgagcgaggcgagaagatcgacgagaacgtgcagcgggagatcatcaaccaccgctccctgcgccaccccaacatcatccgcttcaaggaggtcatcctcaccccgacgcacctcgccatcgtcatggagtacgcctccggcggggagctcttcgagcgcatctgcaacgccggcagattcagcgaggacgaggcgcgtttctttttccagcaactcatatcaggggtcagctactgccattccatgcaagtatgccatcgtgacttgaagctagagaacaccctgttggacgggagcaccgcacctcgcctcaaaatatgtgatttcggctattcaaagtcatcagttctacactctcagccgaaatccacagtgggaactcctgcatacattgctcctgaggttcttctgaagaaggaatacgatggaaaggttgctgatgtctggtcatgcggagtaaccctttatgtgatgctggtcggtgcatatccatttgaggacccagatgagcctaagaattttaggaagacaattcagagaatattgggtgtgcagtactcaattccagactatgtccacatatctccagaatgccaagatcttatttctaggatttttgtcgccaacccagccactaggatcaccatccctgagataagaaaccatccttggttcttgaagaacctcccagctgacctaatggatgacagcacaatgagcaaacagtacgaggagcccgagcaaccaatgcagagcatggatgagatcatgcagatcctggctgaggcgaccattccagcagctggttctcgtggactcaaccagttcctgaacgacggccttgacctcgacgatgacatggaggacctagactcagatgccgatcttgacctggaaagcagtggggagatcgtgtatgctatgtgacagcatcgaatactcagcaacgaggcaatgtgtatcatcaaccgcgctcagatggctctgttgcgtcaaaggttaccaagataatacgcaaggggtgtgcgctgctggcagttgtattgtacttgcaggtatctgctgcatatgctgctcacgcctgatgccgtgatgccccttttctatcatcccgttgtgtttggctgttgtttggtgcacctccagtgttttacaacagtttagccctttggaattgctactgctagaacctcgttcatctgagaagaccctttgtttctgcatccccgactaagggatagcgatgtacttgtatcattacactgtttgtatcatatgtatttggtgtaggaaaataaagaaactccattgcccgttctcttttccatctttatttcatccgtatcttacgatttcttgggaacccaccggagatctttctcagtttttgtgtcttttgacttctgtatatatgtatctcacggttgaatcacaaaggcactatcttg

SEQ ID NO: 450 - DNA, 1654 bp, Sorghum bicolor
gcggttagcaaggcgataaaaagcctttctctctcttggtcagtgacatcacgaactcgtcgacggtagagagagagcaggctctccggcgatttgagaagaaacgggtagcgagagcgcgtgggtgtgtgtgagagagagcgcgaggaggagctgggacttggagactgcgcccggggggccagggtcacggaatcctaccactaccaaccctagcctccgttgatcgccgtctccggccatggcagggccggcgccggatcgggccgccctgactgtggggccgggcatggacatgccgatcatgcacgacagcgaccggtacgagctcgtgcgcgacatcggctccggcaacttcggcgttgcccgcctcatgcgcgaccgccgcaccagcgaactcgtcgccgtcaagtacatagagcgcggcgagaagatagatgagaatgtccagcgtgagataattaaccatagatcattgaaacaccctaacattattaggtttaaagaggttattttaacaccgacccaccttgctattgtcatggaatatgcctctggtggtgagctttttgagagaatatgtaagaacgtgcgattcagtgaagatgaggctcgctacttcttccagcagctcatttcaggagtaagctactgccattcaatgcaagtatgccaccgtgatctgaagctggagaacacacttctagatgggagtgatgctcctcgcttgaagatatgtgacttcggctattccaagtcatctgttcttcattcccagccgaagtccactgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtacgcaattccagacaacgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttgacagaggccaccataccacctgcctgttctcgcagtataaatgtcctagctgatggattggacatggacgacgacatggatgatcttgactctgactcagatcttgatgttgacagcagcggtgagattgtgtacgcaatgtgagtaaccatctcactagtcaaccaaagaaccaatcaggcatgggatgccctgatgttgtatactctggcaaagagctagcatccttttgtgaaaaatcttcctgtagtcttctcagcgaatcgcaacctgttctgtggaacacagatgtagtcaaactggggttactcagcttgtaaaactagcctcctcttgcttcctggttactgaggtttggatactcccgggttcgacctgtgtgttactgttaaatatgtacaagaaacttctactcatgttgatctgtcaatttggactcgggtagtggttttgctc

SEQ ID NO: 451 - DNA, 1655 bp, Sorghum bicolor
gagcaaaaccactacccgagtccaaattgacagatcaacatgagtagaagtttcttgtacatatttaacagtaacacacaggtcgaacccgggagtatccaaacctcagtaaccaggaagcaagaggaggctagttttacaagctgagtaaccccagtttgactacatctgtgttccacagaacaggttgcgattcgctgagaagactacaggaagatttttcacaaaaggatgctagctctttgccagagtatacaacatcagggcatcccatgcctgattggttctttggttgactagtgagatggttactcacattgcgtacacaatctcaccgctgctgtcaacatcaagatctgagtcagagtcaagatcatccatgtcgtcgtccatgtccaatccatcagctaggacatttatactgcgagaacaggcaggtggtatggtggcctctgtcaaaatctgcatgatctgatccatggtctgcattggctggtcaggctcctcatattggttgctcatgctatcatcatccatcagatcagcaggaaggttcttcaggaaccaactatgattccggatttcagggattgttattcgcatagcaggatctccaacaaaaatcctcgaaattagatgcctgcactctggagatatgttcacgttgtctggaattgcgtactgaacgttcaagatgcgctgaattgtcttgcggaagttcttaggctcttctgggtcttcaaaaggatatgcaccaacaaccattacatagagggttacaccacatgaccaaacatcagcaatcttgccatcgtattcttttttcaacagaacttcaggtgcaatataagcaggtgttccaacagtggacttcggctgggaatgaagaacagatgacttggaatagccgaagtcacatatcttcaagcgaggagcatcactcccatctagaagtgtgttctccagcttcagatcacggtggcatacttgcattgaatggcagtagcttactcctgaaatgagctgctggaagaagtagcgagcctcatcttcactgaatcgcacgttcttacatattctctcaaaaagctcaccaccagaggcatattccatgacaatagcaaggtgggtcggtgttaaaataacctctttaaacctaataatgttagggtgtttcaatgatctatggttaattatctcacgctggacattctcatctatcttctcgccgcgctctatgtacttgacggcgacgagttcgctggtgcggcggtcgcgcatgaggcgggcaacgccgaagttgccggagccgatgtcgcgcacgagctcgtaccggtcgctgtcgtgcatgatcggcatgtccatgcccggccccacagtcagggcggcccgatccggcgccggccctgccatggccggagacggcgatcaacggaggctagggttggtagtggtaggattccgtgaccctggccccccgggcgcagtctccaagtcccagctcctcctcgcgctctctctcacacacacccacgcgctctcgctacccgtttcttctcaaatcgccggagagcctgctctctctctaccgtcgacgagttcgtgatgtcactgaccaagagagagaaaggctttttatccccggcccggccggc

SEQ ID NO: 452 - DNA, 1606 bp, Glycine max
ggaggcaaccaccttaaccggcgtcatccacaaaacgacgtcgtcactgtctctcacaagtcacaagtcttccttcccacttgcaccctctctctctcgccggtcgccgaatctttctccgcatccgcaacctccgccgtatccgcctttgattcttcaaccgatggatcggccggcgaccggacctggcgtggacatgccgatcatgcacgatagcgaccgctacgatttcgttcgcgatatcggctccgggaatttcggcgtcgcaaggcttatgagggataagcagacgcaagagcttgttgctgttaagtatattgaacgcggagataagattgatgaaaatgttaaaagagaaatcattaatcacaggtctctaagacatcctaacattatcaggtttaaggaggtcattttaacacctactcatctggccattgtaatggaatatgcatctggtggagagctatttgagaaaatctgcaatgcagggcattttaatgaggatgaggctcgtttcttctttcaacaactcatatctggggtcagctactgtcatgcaatggaagtgtgtcaccgggacctgaagttggaaaacactttgttggatggaagcccggcacttcatttgaagatatgtgattttggatactccaagtcttcggtgcttcattcacaacctaagtcaactgtgggaactccagcatatattgctccagaagtattgctgaagcaagagtatgatggcaagattgcagatgtctggtcatgtggagtaaccttgtttgtgatgctagtgggatcatatccttttgaagatcctaatgatccaaaggatttccggaagacaattcagagggttctcagtgtccagtattccattccagacaatgttcaagtttctcctgagtgtcgccaccttatctcaaggatctttgtttttgaccctgcagagagaatcactattcctgaaatattgcaaaatgaatggtttctgaagaatcttcctccttacttgatggatgaaaagatcatgggtaaccaatttgtagaatcagatcagcccatgcagaacattgatacgatcatgcagataatttcagaagccaccataccagctgcggggacctattctttagaccagtttatggctgataacataatagatgatgacatggatgaattagactccgactttgagcttgatgtagatagcagtggggagatagtgtatgccatataatttaatcatcgtctgcattttagagacagcataatgaaagtacagcatcttaatattcaacacgacgatctcccttaatttaatcatggaaaaagaaatttgtggagatcgtatttcctgtaagattggatgatacacaaagttcatcatgttaatttgtatgttgtatgcttcttggaactgccgaggaagggaacatgattcttactctctagaaggcttggtggcttagaaatcataactacccttccctcttctcctgttgaatacttgttatatatatatatatatatatacacacattaggctttttgttgtctcctgtcagttatattagtgccaggattcttgtttgcaaaaaaa

SEQ ID NO: 453 - DNA, 1767 bp, Glycine max
gaacccaatccactattataattttttttatctcttctcttctctttcccccaacacgtcatttcatttctttcagagagtcttcccttctstcctcttcctcttcacttcttataccgtcgcccccaaacgacgccgtttyctgttctctyatgtaarcgcsgttcgagaacaaaccaaaaaaagaaaagaaaatcagttattgccgttgttgttttgtttccggttcggwttatttsaatggatcgggcggcgttgacggtyggaccgggcatggacatgccgatmatgcacgacagcgaccgttacgatctggtmcgcgacatcgggtccggaaatttcggcgtggcgaggctgatgcaggataaacaaaccaaggaactsgtcgccgtcaagtacatcgaaaggggtgataagattgatgaaaatgtaaagagggaaatcattaatcacaggtctctgaggcatcctaacattgttagatttaaagaggtaattttaacacctactcatcttgctattgtaatggaatatgcatctgggggagagctctttgagaaaatctgcaatgctgggcgttttaccgaggatgaggctcgattcttctttcagcaactcatatctggggtcagctattgccatgctatgcaagtatgtcatcgggacttgaagcttgaaaacactttgctggatggaagcccggcacctcgtttaaagatatgcgattttgggtactccaagtcttcagtgcttcattcacaacctaagtcaactgtgggaactccagcatatattgctccagaagtattgctgaagcaagagtatgatggcaagattgcagatgtctggtcatgtggagtaaccttgtttgtgatgctagtgggatcatatccttttgaagatcctaatgatccaaaggactttccggaagacaattcagagagttcttagtgtccagtattccattccggacggtgttcaaatatctccagagtgtcgccaccttatttcaaggatctttgtttttgacccggcagagagaatcaccatgtctgaaatctggaaccatgaatggtttctgaagaatctcccggcagacctgatggacgagaagataatgggcaatcaatttgaagagccagaccaacccatgcagagcatcgatacgatcatgcagataatttcagaagctaccgtaccagcagttgggacctattcttttgaccagtttatggaggaacaaatttatgacttggaatctgaatctgatgctgaatctgatcttgatatagatagcagtggggagatagtgtatgccatatagtttgatcttagttacacttgaaagacaacaacatattaaatggagagagcattttcagcatcaagagatatatacgtggtgcccgcattttctgtagattagcatggataatacaaacttcatgttaatatttatgtattcagtgttggttgctgagggaagaaatgattgttaccctttgctcacttccaggggaatgcttgctttatatataatattatattatttgagatcgtatttcctgtaagattggatgatacacaaagttcatcatgttaatttgtatgttgtatgcttcttggaactgccgaggaagggaacatgattcttactctctagaaggcttggtggctgagaaatcataaytacccttccctcttytcctgttgaatacttgtttggcttcttgtttgccatataattcagtgttggttgctgaggga

SEQ ID NO: 454 - DNA, 1512 bp, Glycine max
gattttttttatctcttctcttctctttcccctcaccaacacgtcatttcatttctttcaaagtcttcccttctctcctcttcctcttcacttcttaaaccgtcgccccttaacgacgccgtttcctgttctctcatgtaagcgcggttcgagaaaaaaaaaagaaaatccgttattggcgttgttttatttttgtttccggttcggattatttgaatggatcgggcggcgttgacggtcggaccgggcatggacatgccgataatgcacgacagcgaccgttacgatctggtccgcgacatcgggtccggaaatttcggcgtggcgaggctgatgcaggataaacaaaccaaggaactcgtcgccgtcaagtacatcgaaaggggtgataagattgatgaaaatgtgaagagggaaattatcaatcacaggtctctgaggcatcctaacattgttaggtttaaagaggtaattttaacacctactcatcttgctattgtaatggaatatgcatctgggggagagctctttgagaaaatctgcaatgctgggcgttttaccgaggatgaggctcgattcttctttcagcaactcatatctggggtcagctattgccatgctatgcaagtatgtcatcgggacttgaagcttgaaaacactttgctggatggaagcccggcacctcgtttaaagatatgcgattttgggtactccaagtcttcagtgcttcattcacaaccaaagtcaactgtgggaactcctgcatatattgctccagaagtattgctgaaacaagagtatgatggcaagcttgcagatgtctggtcatgtggagtaaccttatatgtgatgctagtgggagcatatccttttgaggatcctaatgaaccaaaggactttcggaagacaattcagagagttcttagtgtccagtattccattccggacggtgttcaaatatctccagagtgtcgccaccttatttcaaggatctttgtttttgacccggcagagagaatcaccatgtctgaaatctggaaccatgaatggtttctgaagaatctcccggcagacctgatggacgagaagataatgggcaatcaatttgaagagccagaccaacccatgcagaagcatcgatacgatcatgcagataatttcagaagctaccgtaccagcagttgggacctattcttttgaccagtttatggaggaacaaatttatgacttggaatctgaatctgatgctgaatctgatcttgatatagatagcagtggggagatagtgtatgccatatagtttgatcttagttacacttgaaagacaacaacatattaaatggagagagcattttcagcatcaagagatatatacgtggtgcccgcattttctgtagattagcatggataatacaaacttcatgttaatatttatgtattcagtgttggttgctgagggaagaaatgattgttaccctttgctcacttccaggggaatgcttgctttatata

SEQ ID NO: 455 - DNA, 1749 bp, Glycine max
gaacccaatccactattataattttttttatctcttctcttctctttccccctacacgtcatttttcatttctcagagagtcttcccgtctcttcctcttcacttcttataccgtcgcccccaaacgacgccgttttctgttctcttatgtaaacgccgttcgagaacaaaccaaaaaaagaaaagaaaatcagttattgccgttgttgttttgtttccggttcggtttatttcaatggatcgggcggcgttgacggttggaccgggcatggacatgccgatcatgcacgacagcgaccgttacgatctggtacgcgacatcgggtccggaaatttcggcgtggcgaggctgatgcaggataaacaaaccaaggaactggtcgccgtcaagtacatcgaaaggggtgataagattgatgaaaatgtaaagagggaaatcattaatcacaggtctctgaggcatcctaacattgttagatttaaagaggtaattttaacacctactcatcttgctattgtaatggaatatgcatctgggggagagctctttgagaaaatctgcaatgctgggcgttttaccgaggatgaggctcgattcttctttcagcaactcatatctggggtcagctattgccatgctatgcaagtatgtcatcgggacttgaagcttgaaaacactttgctggatggaagcccggcacctcgtttaaagatatgcgattttgggtactccaagtcttcagtgcttcattcacaaccaaagtcaactgtgggaactcctgcatatattgctccagaagtattgctgaaacaagagtatgatggcaagcttgcagatgtctggtcatgtggagtaaccttatatgtgatgctagtgggagcatatccttttgaggatcctaatgaaccaaaggactttcggaagacaattcagagagttcttagtgtccagtattccattccggacggtgttcaaatatctccagagtgtcgccaccttatttcaaggatctttgtttttgacccggcagagagaatcaccatgtctgaaatctggaaccatgaatggtttctgaagaatctcccggcagacctgatggacgagaagataatgggcaatcaatttgaagagccagaccaacccatgcagagcatcgatacgatcatgcagataatttcagaagctaccgtaccagcagttgggacctattcttttgaccagtttatggaggaacaaatttatgacttggaatctgaatctgatgctgaatctgatcttgatatagatagcagtggggagatagtgtatgccatatagtttgatcttagttacacttgaaagacaacaacatattaaatggagagagcattttcagcatcaagagatatatacgtggtgcccgcattttctgtagattagcatggataatacaaacttcatgttaatatttatgtattcagtgttggttgctgagggaagaaatgattgttaccctttgctcacttccaggggaatgcttgctttatatataatattatattatttgagatcgtatttcctgtaagattggatgatacacaaagttcatcatgttaatttgtatgttgtatacttcgtgaactgccgaggaggggaacatatttctaagactcagaagggttgggggttgagaattcataattaccctttcctcttttcctgttgaaggcttcttgtttgccatataattcagtgttggttgctgaggg

SEQ ID NO: 456 - DNA, 1961 bp, Glycine max
tacggctgcgagaagacgacggaaggggaacccaatccactattataattttttttatctcttctcttctctttcccctcaccaacacgtcatttcatttctttcaaagtcttcccttctctcctcttcctcttcacttcttaaaccgtcgccccttaacgacgccgtttcctgttctctcatgtaagcgcggttcgagaaaaaaaaaaagaaaatccgttattggcgttgttttatttttgtttccggttcggattatttgaatggatcgggcggcgttgacggtcggaccgggcatggacatgccgataatgcacgacagcgaccgttacgatctggtccgcgacatcgggtccggaaatttcggcgtggcgaggctgatgcaggataaacaaaccaaggaactcgtcgccgtcaagtacatcgaaaggggtgataagattgatgaaaatgtgaagagggaaattatcaatcacaggtcgtccggattcccgcgtcgacccacgcgtccgtgaaaatgttaaaagagaactcattaatcacaggtctctaagacatcctaacattatcaggtttaaggaggttattttaacacctactcatctggccattgtaatggaatatgcatctggtggagaactatttgagaaaatctgcaatgcagggcgttttaatgaggatgaggctcgtttcttctttcaacaactcatatctggggtcagctattgtcatgcaatggaagtgtgtcaccgggacctgaagttggaaaacacgttgttggatggaagcccggcgcttcatttgaagatatgtgattttggatactccaagtcttccgtgcttcattcacaacctaagtcaactgtgggaactccagcatatattgctccagaagtattgctgaagcaagagtatgatggcaagattgcagatgtctggtcatgtggagtaaccttgtttgtgatgctagtgggatcatatccttttgaagatcctaatgatccaaaggatttccggaagacaattcagagggttctcagtgtccagtattccattccagacaatgttcaagtttctcctgagtgtcgccaccttatctcaaggatctttgtttttgaccctgcagagagaatcactattcctgaaatattgcaaaatgaatggtttctgaagaatcttcctccttacttgatggatgaaaagatcatgggtaaccaatttgtagagtcagatcagcccatgcagagcattgatacgatcatgcagataatttcagaagctaccatacccgctgcagggacctattctttagaccagtttatggctgataacataatagatgatgacatggatgaattagactccgactttgagcttgatgtagatagcagtggggagatagtgtatgccatataatttaatcatcgtctgcattttagagacagcataatgaaagtacagcatcttaatattcaacacgacgatctcccttaatttaatcatggaaaaagaaatttgtggagatcgtatttcctgtaagattggatgatacacaaagttcatcatgttaatttgtatgttgtatgcttcttggaactgccgaggaagggaacatgattcttactctctagaaggcttggtggcttagaaatcataactacccttccctcttctcctgttgaatacttgttatatatatatatatatacacacattaggctttttgttgtctcctgtcagttatattagtgccaggattcttgtttgcatatacctgcttttgtagttttgtacacatactccttgttaccattcctctaggagttcttgcgtttatcttgtgatctagaacatctcattcctgttcaccatttcagttttttgcatatttccgatggaacattgttgtacctcgtcctcttctatgctgcaatgcaagtcacgaagctgtgaatgctact

SEQ ID NO: 457 - DNA, 1913 bp, Glycine max
acggtccgaatgttcccgtaatcgaccaccgaaagaaagagagagatagagaaaaaaaagcaaagcaaagaaggttcacgttcacgttctgttctgttctggttcacactttcacgagcctatcaccgactctctgcacctgcaactgcaacttccaacttcaacttcaaccactgcaagcttagctctgaaagaaaagaaaagaaaaagaaaatatctccatttggtttggttggtgaaagttgaaaccttttcacgagctcaagttggtagtaacttttttaacttggcggtctctttttttctacatcgactctcgttgtgttttgcaaagatctgatctgggtcgtggatatttcaatgtgaaagttaaggttttttttgttgcatagtaataattgaaagaaacaaaaaaaggtgggatttttaaagggggtggtggagatggatcgttctgctatgactgttgggccaggaatggatatgccgatcatgcatgacagtgacaggtatgagctggtccgtgatattgggtctgggaattttggggtggcaaggctcatgagagacaagcacactgaggagcttgttgctgtcaagtatattgagagaggtgataagatagatgaaaatgtacgaagggaaattataaatcacagatcactgaggcatcccaatattgtcaggttcaaggaggtaatattracccctacacatttggctattgtgatggagtacgcttctgggggagagttatttgagcggatatgcaatgcaggacggtttagtgaagatgaggcacgcttcttcttccaacaacttatatcaggggttagctactgtcatgcaatgcaagtatgccatcgtgacttgaagttggagaacacattgttggatggtagtccagctcctcgtttgaagatttgtgattttgggtattcaaagtcctccgtgctacattcacaacctaaatctacagtcggtacccctgcatacattgctcctgaagttttgcttaagaaggaatatgacggcaagattgcagatgtgtggtcttgtggggtgaccttatatgtcatgttggtgggtgcatatccttttgaggatccagaggaacctaaaaatttccggaagacaattcataggattttgaaagtccagtactcaattcctgattatgttcatatatcttccgagtgccgtcatctaatctcaaggatctttgtggcagaccctgcacagagaataagtattcccgagattcgaaaccacgagtggtttttgaagaacctgccggctgatctcatggttgagaacacgatgaacaaccagtttgaggagcctgatcaaccaatgcagagcattgaagaaatcatgcagataatcagtgaggctacaattcctgcagccggaactcagtctctcaaccagtatcttaccggtagcttggacattgatgatgacgacatggatgaggacctagagacggatcccgacctcgacattgatagcagtggagaaatagtttatgcaatgtaagctgctggcaaacaatgcaaactgacttctctgatcaatttataatatagtatagccatgggttgttcarwgggtttggaatatstgggaarraaaagatttcacatctgaagggaaggattctgtgaaaaagtttgttttttttttttatgttgygaggatcattcctgcttatatktywatggtcctttcatgattacatgctgctttgtattgatagttgtggtcattgttatattatgaagtggttgcctttcccttttcatttccttggaattagtactttgttctcgtcatatggtcatatgttaggttattttcattttgaaaaatgatagtttataaaggagataagggtcatccattaatagtgg

SEQ ID NO: 458 - DNA, 1574 bp, Saccharum officinarum
  misc_feature (1423)..(1423): n is a, c, g, or t
  misc_feature (1513)..(1513): n is a, c, g, or t
  misc_feature (1517)..(1517): n is a, c, g, or t
caggctcttcggcgatttgagaggaaacgaggagcgagactactgcgagagagcgtgggcgtgtgtgggagagagcgcgaggagcagctgggacttggagcctgcgcccggggggccccgggtcacggaatcctaccactaccaaccctagcctccgttgatcgccgtctcaggccatggcagcgccggcgccggatcgggccgccctgactgtggggccgggcatggacatgccgatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaaacaccctaacattattaggtttaaagaggttattttaacaccgacccaccttgctattgtcatggaatatgcctctggtggtgagctttttgagagaatatgtaagaacgtgcgattcagtgaagatgaggctcgctacttcttccagcagctcatttcaggagtaagctactgccattcaatgcaagtatgccaccgtgatctgaagctggagaacacacttctagatgggagtgatgctcctcgcttgaagatatgtgacttcggttattccaagtcatctgttcttcattcccagccgaagtccaccgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtatgcaattccagacaatgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgatcagccaatgcagaccatggatcagatcatgcagattttgacagaggccaccataccacccttcctgttctcgcagtataaatgtcctagctgatggattggacatggacgacgacatggatgatcttgactccgactcagatcttgatgttgacagcagcggtgagattgtgtacgcaatgtgagtaaccatctcactagtcaaccaaagaaccaatcaggcatgggatgccctgttgttgtatactctggcaaagagctatagcatccttttgtgaaaaatctcctgtagttttctcagcgaatcgcaacctgttctgtggaacacanatgttgtagtcaaacctgggggtactcaacttggtaaactagccctccccttgcttcctggtactgaggtttggatactctcaggcttcnactngtgtgttggctgtaatattgacatgaaacttctactcatggtgatctgggaatttgg

SEQ ID NO: 459 - DNA, 1570 bp, Saccharum officinarum
  misc_feature (6)..(6): n is a, c, g, or t
gtactnccacycktccgtttgagaggaaacgaggagcgagactactgcgagagagcgtgggcgtgtgtgggagagagcgcgaggagcagctgggacttggagcctgcgcccggggggccccgggtcacggaatcctaccactaccaaccctagcctccgttgatcgccgtctcaggccatggcagcgccggcgccggatcgggccgccctgactgtggggccgggcatggacatgccgatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaaacaccctaacattattaggtttaaagaggttattttaacaccgacccaccttgctattgtcatggaatatgcctctggtggtgagctttttgagagaatatgtaagaacgtgcgattcagtgaagatgaggctcgctacttcttccagcagctcatttcaggagtaagctactgccattcaatgcaagtatgccaccgtgatctgaagctggagaacacacttctagatgggagtgatgctcctcgcttgaagatatgtgacttcggttattccaagtcatctgttcttcattcccagccgaagtccaccgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtatgcaattccagacaacgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgatcagccaatgcagaccatggatcagatcatgcagattttgacagaggccaccataccacctgcctgttctcgcagtataaatgtcctagctgatggattggacatggacgacgacatggatgatcttgactccgactcagatcttgatgttgacagcagcggtgagattgtgtacgcaatgtgagtaaccatctcrctagtcaaccaaagaaccartcaggcatgggatgccctgttgttgkatactctggcaaagagctatagcatccttttgtgaaaaatctcctgtagttttctcmgcgaatcgcaacctgttctgtggaacacaaatgttgtagtcaaactgggggtacyyarsttgkwaaactagcctccccttgcttmctggtactgggyttggatacttmmgscttcgacttgkgtgttrctgkrrwattgmcakgaaacttmtmytcatggtgatctgggaatttgg

SEQ ID NO: 460 - DNA, 1448 bp, Helianthus annuus
  misc_feature (1307)..(1307): n is a, c, g, or t
  misc_feature (1316)..(1316): n is a, c, g, or t
ttttttcacacgaaacaacaatcggcgtatatattcaactcctgtggtaataccaaagattcaaaaaacacaaccctgactcccatctagacatgttaccacaacccgtaaacaattctacgtacatgaaaacttacaacaacgtgtatatagcttcgaccattacatagcatatatgatctcaccactgctatcgatatcaagttcgtcagggtcagagtcaaagtcatcaagatcatcatcatccatcatatcaagatcatagaggcctgcaggtggaatggtggcttcagatataatctgcatgattgtgtccacgctctgcatcggttgatcaggctcttcaaacsggttgctcatcgtcttatcttcrtccatgaggttagcggggtggttctttagaaaccaatcatgcytctttatctcatccatggtgattctctgtgcagggtctgccacaaatattcttgagatgaggtgccgacattcaggggatatctgaatgttttctggaattgaatactgaacatgaagaattctatgaatcgtcttgcgaaaatcttttggttcgttagggtcttcaaacgggtagccgccaatgagcatgatgtataatgtcaccccacatgaccacacatctgcaatctttccatcatattcttgcttgagcaacacttcaggagctatgtatgctggtgtaccgactgtcgattttggctgcgaatgcagcactgaggatttggagtaaccgaaatcacaaatcttcaaacggggagccgggcttccatccaacaaagtgttctctagcttcaaatcgcggtgacaaacttgcatagagtgacagtaactgacaccagatataagttgttgaaagaagaaccgggcctcatcctcattgaagcgccctgcattggaaattctatcgaataattcgcccccrgaagcatattccatcacaatcgccaaatgggtcggtgtcaatatgagctctctgaacctaactatgttaggatgtctaagagacctgtgattgatgatttccctttgaacattctcgtctatcttttggcctctttcaatatacttaacagcaacaagttctttggtctgtttatctctcataagcctagcaactccaaagttcccagccccaatatctttaaccaaatcataccggtcactatcatgcatgatcggtagatccatacccggcaccatggaccgatccatttcctgawrrgtcaagatcaagwtcamtacawaactytraactcaagatcaactgcaacacaacatctgatcactanagatccttngaacaacctccttaatgtataaagattgtaaagaaacagattgagagaataaaggcggctgctttttcaagaattgaaagattttggggaggggggggtgtatgagtataagatatttttttttgttgttga

SEQ ID NO: 461 - DNA, 4166 bp, Nicotiana sp.
ggccattacggccggggctctataaacacacacacacaaagaagtggaattagcacgtctgctaaatcaaaacgctaaatagaagtggaatctgatcatttacttcgctgtagtaagtacagatttcacgggatttgagctcatccctcatcacttgttgttgttgttgttgttgccgtccctgtctttcttcaactaccaactatactcaatcttgtgattcatcttcctccacgtagcttagcttgttgaagttaaaaaggagagctttatggatcgggtggcaatggcagtaggagcagggatggacgtgccgatcatgcacgatagtgatagatacgagctagtaaaggatattggttctgggaattttggagtggcaaggcttatgagggacaggcaaactaatgagcttgttgctgttaagtatatcgagagaggtgagaagattgatgaaaatgttaagagagaaatcatcaaccatagatcattgaggcaccctaacatagtcagattcaaagaggtcatattgacaccaactcatttggctatagtgatggaatacgcatctggaggagaactgtttgagcgcatatgcaatgcaggccgtttcagcgaggatgaggcacggtttttcttccaacaactcatatcaggggtcagcttctgtcacgccatgcaagtatgccacagagacttgaaactggagaatacattattggatggcagccctgcaccaaggctaaagatttgtgattttggatattctaagtcctcggtgttgcattcacaaccaaagtcaactgttggtacacctgcatatattgctcctgaagcgttattgaagaaagaatatgatgggaagattgcagatgtctggtcttgtggggtgactttgtatgtcatgctggtaggagcatacccttttgaagacccagaggagcctaaaatttttcgcaagacaatacagcgaatcttgaatgtacagtattcaattccagattatgtacatatctctccagaatgtcgtcatctaatatcaaggatttttgttgctgatcctgcaaagaggataacgatccctgagatcaagaaccatgagtggttcttgaggaaccttcctgcagatctcatggatgataatatgacaaacaatcagtttgaggagccagatcaacgtatgcagagcattgacgaaatcatgcagataataactgaggccaccattcctgctgctgggaccaacagccttaatcattaccttactggtatcttggacattgatgatgacatggaagaagacatggagagtgaccctgaccttgatattgatagcagcggagagattgtctatgcaatgtaaatgatatgtgcgtactaagttgatggatcaaactaaaccagccgaatgtttgtagttcttaattatctggtctgccttttggtatccactggttttttctctctatttttttcttcatttctagccggagctccggtagtccgccgtcggtcggagttatgggagcgccaattttatcagatctcggaacggagattttgattccggtatgtgccgtcgtcggtattgctttctcgctatttcagtggtttctcgtctctaaagtgacgctcagtgctgataagtcctccggcgccgccgacgataagaatggttacgctgctgaatcgctcattgaagaagaagaaggcattaatgaccataatgttgttcagaaatgtgcagaaattcaaaacgccatttccgaaggtgcaacatcattcctttttactgagtaccagtatgttggtgttttcatggttgcttttgcaattttaatcttccttttcctcggctctgttgagggtttcagcacaaagaaccaaccctgtacatatgacagcaccaaaacttgcaagcccgctcttgccactgctgtcttcagcaccgtatctttcttgcttggtgctgttacatctgtggtgtccgggtttcttggaatgaaaattgctacatatgcaaatgccagaactaccttggaggctagaaaaggtgttgggaaggcttttattgttgcattcagatctggtgctgtgatgggtttccttcttgctgcaaatggtcttctggttttgtacataaccatccttctatttaagttgtactacggtgatgactgggaaggtctttttgaggctataacaggttatgggcttggtggatcttcaatggccctctttggtagagttgctggaggtatttataccaaagcagcagatgttggagctgatcttgtgggcaaggtggaaaggaacatccctgaagatgatcctagaaacccagcggttattgctgacaatgtcggtgacaatgtcggagatattgctggtatgggatcagatctgtttggatcttatgcagagtcatcctgtgcagctcttgttgttgcttcaatctcctccttcggtgtcaaccatgagttcactgctatgctatatccccttctcgtcagctctgttggyatccttgtttgtttgcttaccaccttattygcaactgatttctttgaagtcaaggctgttaaggaaattgagccagcattgaagcagcaactygttatctcaactgctctcatgacagttggaattgctgttgttacttggattgcccttccatcgaccttcacaatattcaatttcggggctcagaaagaagtaaaaagctggcagttgttcttgtgtgtcggagttggtttgtgggctggacttattattgggttcgtcaccgagtactataccagcaatgcttacagccctgtgcaagatgttgctgattcatgtcggactggtgctgcaacaaatgttatttttggtcttgccttgggttataaatcagtgatcatccccatatttgccatagcagtcagtatatttgttagcttcagctttgctgcaatgtatggcattgcagttgctgccctaggaatgctgagcactatagccactggtttggcaattgatgcatatggtcccatcagcgataatgcaggaggcattgctgagatggctggaatgagccacagaatcagagagagaactgatgcacttgatgctgcaggaaacaccactgcagctattggaaagggatttgccattggttctgctgctctcgtgtctctggccctctttggagcatttgtcagccgagcagcaatttccactgtagatgtcttgacacctaaagtatttattggtttgctagtcggtgcaatgcttccttattggttctccgccatgacaatgaagagtgttggaagtgctgctcttaagatggttgaggaagtgcgcaggcaattcaacaccattcctggtctcatggaaggaactgccaagcctgactacgccacctgtgtcaagatctctacagatgcatcgatcaaggagatgattgcacctggtgctcttgtcatgctcactccattgattgttgggatcttgtttggcgtcgaaacactttctggtgtgcttgcaggatctctcgtctccggtgtacagattgccatctctgcatctaatacaggtggtgcctgggataatgctaagaagtacattgaggccggagtctcagaacacgcaagaacacttggccccaagggatctgacgcacacaaggctgctgttattggtgacactgttggtgaccctctcaaggacacatctggaccatcattgaacattctcatcaagctgatggctgtcgaatccctcgtgttcgctcccttcttcgccactcacggtggtcttctcttcaagctattttaaaacgaatgtcactcctatgtcacacgactgtctcacgaaatctatcgttcctctttctccctttctcttcgtttaactacctttccagcatttttcgtgtttttagtcactagaatgtgggctgtggaaggagagagattcacgacaatgagtgttgatgaaaggtgatggtaagggtgaaatgtttttgcagaattcagaagaacgtcaatattctttcctagagtatwgtatcagtttcttaaaataccttcttctcttgcccgtttcgggtgttaagattttgaatttttcttatgctctctccaaaatctgcaatataacatgaggtagatattacttcc

SEQ ID NO: 462 - DNA, 1669 bp, Solanum lycopersicum
atatatattattaataattaaataaacagaagatattttcattactttgccgaccatacataaaatatctttccccaaaaacttcattaccggaaaaaaggtcaaaaagtacgaaaaaacccaccgcctttatgctccatttcttcacatataccttcttatctgaggctaaaattgacttatcactactcggttctttgtgttggttggtcaaccggtagtattcagctccgatcaccagttccggtaactggtaaccattggtgagaaagctttgggatgtaaatcgagcttagtttgagctgaatctgaggtagcagacgaaatggatcgaggtccgggaccgtgtatggatatgccgatcatgcacgatagtgaccggtacgattttgttagagatatcgggtcgggtaactttggcgttgcgaggttgatgacagataagcagactaaagagctagttgctgtcaagtacatcgaaagaggcgataagatagatgaaaacgttcagcgggagataatcaatcacaggtcgctgaggcatcctaacataattaggttcaaagaggtgattctgacgccaactcatctcgctattgtgatggagtatgcatctggtggggagctttttgagagaatctctaatgcggggcgcttcaatgaggatgaggctcgcttcttcttccagcaacttatatctggtgtcagctactgtcactccatgcaagtatgtcatcgggacttgaagctggaaaatacgttgcttgatggaagccctgctcctcggctaaaaatttgtgattttgggtattccaagtctgctctgctgcattcacagccaaaatcaactgtgggaacacctgcatatattgcaccagaagttttgttgaggaaagaatacgatggcaagattgcagatgtctggtcgtgtggagtgacattgtatgtcatgttagtgggtgcttacccttttgaggatcctgatgaaccaaaagattttcggaagacgatcaataggatcctgagcgtgcagtattctgttcctgagaacattcagatatctgaggaatgtcgccacttaatctcaaggatctttgttggagatccggcacagaggatcacaatgcctgaaatcaggaatcatgtatggtttttgaagaatcttccagcggacttaatagacgataggatgattagtgatcagtttgaagaacccgatcaaccaatgcagagcattgatacgatcatgcaaataatctcagaggcaacagtaccaccaattggcttgtataacttggaaatgatggacgatgacatggatgacttggattcagagcctgatcttgatattgatagcagcggggagatcatatatgcaatgtgagtgcatgccaagcttgtgaaaaggaaggtgtatccacaatcttagaacatttctggacttgttggtgtgcaaggcttagagattgttgaagctcagtaacatgaaaatggggtatttacaatgtttgtaattagtcaagttcttatcctgaaaggggcttttagtctgcccatgaattatttcttctattaccataggaggaattggctgaaaaagtaatggagtttccatacttgagttcataatctctttataatgtcatacaggtgttgttcttttgtaaaa

SEQ ID NO: 463 - DNA, 1758 bp, Solanum lycopersicum
ggagagagaatatatattattaataattaaataaacagaagatattttcattactttgccgaccatacataaaatatctttccccaaaaacttcattaccggaaaaaaggtcaaaaagtacgaaaaaacccaccgcctttatsctccatttcttcacatataccttcttatctgaggctaaaattgacttatcactactcggttctttgtgttggttggtcaaccggtagtattcagctccgatcaccagttccggtaactggtaaccattggtgagaaagctttgggatgtaaatcgagcttagtttgagctgaatctgaggtagcagacgaaatggatcgaggtccgggaccgtgtatggatatgccgatcatgcacgatagtgaccggtacgattttgttagagatatcgggtcgggtaactttggcgttgcgaggttgatgacagataagcagactaaagagctagttgctgtcaagtacatcgaaagaggcgataagatagatgaaaacgttcagcgggagataatcaatcacaggtcgctgaggcatcctaacataattaggttcaaagaggtgattctgacgccaactcatctcgctattgtgatggagtatgcatctggtggggagctttttgagagaatctctaatgcggggcgcttcaatgaggatgaggctcgcttcttcttccagcaacttatatctggtgtcagctactgtcactccatgcaagtatgtcatcgggacttgaagctggaaaatacgttgcttgatggaagccctgctcctcggctaaaaatttgtgattttgggtattccaagtctgctctgctgcattcacagccaaaatcaactgtgggaacacctgcatatattgcaccagaagttttgttgaggaaagaatacgatggcaagattgcagatgtctggtcgtgtggagtgacattgtatgtcatgttagtgggtgcttacccttttgaggatcctgatgaaccaaaagattttcggaagacgatcaataggatcctgagcgtgcagtattctgttcctgagaacattcagatatctgaggaatgtcgccacttaatctcaaggatctttgttggagatccggcacagaggatcacaatgcctgaaatcaggaatcatgtatggtttttgaagaatcttccagcggacttaatagacgataggatgattagtgatcagtttgaagaacccgatcaaccaatgcagagcattgatacgatcatgcaaataatctcagaggcaacagtaccaccaattggcttgtataacttggaaatgatggacgatgacatggatgacttggattcagagcctgatcttgatattgatagcagcggggagatcatatatgcaatgtgagtgcatgccaagcttgtgaaaaggaaggtgtatccacaatcttagaacatttctggacttgttggtgtgcaaggcttagagattgttgaagctcagtaacatgaaaatggggtatttacaatgtttgtaattagtcaagttcttatcctgaaaggggcttttagtctgcccatgaattatttcttctattaccataggaggaattggctgaaaaagtaatggagtttccatacttgagttcataatctctttataatgtcatacagtgttgttcttttgtaactcgtgtacttttcttatatgcgtgttgtgtcaaaacaaagttatgtgctctttcctggttttgtgtaagttaaagaatgctt

SEQ ID NO: 464 - DNA, 1769 bp, Solanum lycopersicum
aattaacgagaatgaatgaatttcgaatattatattgtcatatacctaaaatagagtaacaaaatgagtaaagtaaccaaaaaaatgatgtctgcgtgtgcactttggaaacccaaagaagaagtagctgaaaaaactaataaagaaataaagaagaaaagcagcttacttcacgagctcctctgagcacacaacaaaaaagatattgatatatatatatatatgcaggttgatgaagaacacgtctgctcaatcaaaaccctaacagaactgcgatctcatcatctactttaatttgctgtagagaaaagggtgggttgtaataatgtgagaggtagcttgttcaagttaaaaagagagagaggttgtgttgaactatggatcggacggcagtgacagtaggaccaggtatggacgtaccgatcatgcacgatagcgatagatatgaacttgtacgggatattggtgctgggaattttggtgttgcaaggcttatgagagataggcagactaatgaacttgttgctgttaagtacatcgagagaggtgagaagattgatgaaaatgttaagagagaaatcatcaaccatagatcattgaggcatcctaacatagtcagatttaaagaggtcatactcacaccaactcatttggctattgtgatggaatttgcatctggaggggagctgtttgagcgcatatgtaatgctggtcgttttagcgaggatgaggcacggtttttcttccaacaactcatatcaggggtcagttattgtcatgctatgcaagtgtgccatagagacttgaaattagagaatacattactggatggaagtcctgcaccaaggttaaagatttgtgattttggatattctaagtcctcggtgttgcattcacaacctaagtcaactgttggtacacctgcatatattgctccagaggtgttattgaagaaagaatatgacggaaagattgcagatgtctggtcttgtggagtgactttgtatgtcatgctggtgggagcatacccttttgaagacccagaggaacccaaaaattttcggaagacaatacagcgaatcttgaacgtacaatattcgattcctgattatgtacatatctctcctgaatgtcgtcatctaatatcaaggatttttgttgcagatcctgcaaagaggatatcaatccctgagatcaagaaccatgagtggttcttgaagaaccttcctgcagatctcatggataatactacaaacaaccagtttgaggagccagatcaacgtatgcagagcattgacgaaatcatgcagataataactgaggccaccattcctgctgctgggaccaacagccttaatcattacctcactggaagcttggacattgacgatgacatggaagaagatttggagagtgatcctgacctcgatatcgatagcagtggagagattgtctatgcaatgtaaaagatatgtggatgtctaaattgacaacagatcaaatataaccagtttgactttcgcagatcttaatcagctgggcgatcttttggtatccactgtttgtatatgaaatgcaagtttgcagcaattcaggttctccgctctttgttttctttagtgactgttgctgttatgtattgcttgatttcactttctaattaatgcgtgttattgcaaaaactactgtgtaatgatataatttcacagtaatgcttactctgtagctgtaaattttcttctgttactaaatgtaagatagttttaact

SEQ ID NO: 465 - DNA, 1430 bp, Triticum sp.
ccacgcgtccgyasgargaaaggtycgacagckagcgagcgagcgagcgagagagataaggagagagggcgcgcgcggggatctccgtgycttggtcggcggtagagtcgtcggcgcgggggcgatggagagsgggccggcgggcacgatgggggggccgctgagtgacgtgccggcgatgctcgacggcgaccggtacgagctggtccgcagcatcgggtccggcaacttcggygtcgcccgcctcatgcgcaaccgcgcctccggcgagctcgtcgctgtcaagtacatcgaccgcggcgagaagatcgatgagaacgtgcagagagagatcatcaaccacaggtcgctgcggcatcccaacatcatccgcttcaaggaggttattctgacgccgacgcatctcgccatcgtcatggagtacgcctccggcggggagctcttcgagcgcatctgcactgccggccgattcagcgtcgacgaggctcggttctttttccagcagctgatatctggagtcagctactgccactccatgcaagtgtgccatcgtgacttaaagctcgagaacactctgctggatggaagcaccacccctcgcctcaagatatgcgactttggttattccaagtcatcggtgctacattctcaaccaaagtcaactgttggaactccggcatatattgcccctgaagttctgctcaagaaagaatacgatggcaagattgccgatgtgtggtcctgtggcgtaaccctttacgtgatgttggtcggcgcctaccctttcgaggatccrgaaaatcccaagaatttcaaagtgacaattcagaaaatattaggtgttcagtactcgattccggactatattcacatacctatggactgccgaaaccttctctcaaggatctttgttgccaacccagctacgaggatcaccatacctgagataaagaaccacccatggttcctcaagaacctcccagctgacctcatggacggtcccacagtgagcaaccagtatgaggagcctgaccagccgatgcagaacatgaacgagatcatgcagataatggcagaggcgaccataccggcggccggcgccctcggaatcaataagttcctgcctgacggccttgacctcgacgacgacatggacgacctggactcggacctcgacatcgacatggacagcagcggggagatagtatacgccatgtagtaaacctgtgaatatctgtatgtgcagaagcggtatttgtggtcttccaccttgtttgcttcttgaacatacaccagattgagtgccattttgtgttaagaagaagagtgtagaaatgtacatygagaggattgtattcaggctactcttgagtctgaaattggtgttgctgctgatagtgtagcgtgtgttgtctaacaaaatacagtat

SEQ ID NO: 466 - DNA, 1417 bp, Triticum sp.
gggcggcgctgacggtggggccgggcatggacatgcccataatgcacgacggcgaccgctacgagctcgtcaaggacatcggctccggcaacttcggcgtcgcgcgcctcatgcgcaaccgcgccgacggccagctcgtcgccgtcaagtacatcgagcgaggggagaagattgacgagaacgtgcagcgggagatcatcaaccacmggtcgctgcgccaccccaacatcatccgcttcaaggaggtcatcctcacgcccgacgcacctcgccatcgtcatggagtacgcctccggcggggagctcttcgagcgcatctgcaacgccggcaggttcagcgaggacgaggcgcgtttcttcttccagcagctgctctcaggagtcagctactgccactccatgcaagtatgccatcgtgacttgaagctggagaacaccctgctggacgggagcacggctcctcgcctcaagatatgcgactttggctattccaagtcgtcggttcttcattcgcagccaaaatctaccgttggaacaccggcatacattgctccggaggttcttctgaagaaggaatatgatggaaagattgcggatgtgtggtcctgtggagtgacactttatgttatgctagttggtgcatatccctttgaggatcctgatgagcccaaaaattttaggaagacaattcagaggatattgagtgtgcagtactcgattcccgattacgtgcacatatcttccgagtgtcgagatcttatcgccaagattttcgttggcaacccagctaccagaatcacaatcccggagataagaaaccatccgtggttcttgaagaacctcccagctgacctagtggacgacagcaccatgagcagccagtatgaggagcctgaacagccgatgcagagcatggacgagatcatgcagatcctggcggaggccaccatcccggccgctggttcccggatcaaccagttcttgaacgacggtctggaccttgacgacgacatggacgaccttgattcagacgccgacctcgacgtcgaaagcagcggggagatagtgtatgctatgtgacagtgcaaaacctctcaacgaagcagytmttctataagttgaccgtaagatgccaagctactcgagactctcagaagggatagggtaccgcggtgcttgatagcccgcccacaaatgttactttgttgtagttggtctctgtacttccaatgttgtagtacaacggtttggccttttggatgtgaccttgtgttgctccaatgctgtgttgactatctctgctgatttgagaactggtagatcatctgtaacccgtgtcrtcacatcatgtttgtaccatgtatatgtgttgtaggcaaataagagacactacagyttgatcagtttcgtttcgacc

SEQ ID NO: 467 - DNA, 1465 bp, Triticum sp.
ccacgcgtccgwctctcggtcggccagtgtcgcacgaactcgtcgcggtggaggggagagaggggggttgagctcgccgtcgattcgaggggagaggaggcgggaagagaggggcggccaccccggggaaaccgagccctatcggccgcggcccccctccatcgaccgccagtcgccgccggccatggcaggggcggcgccggatcgggcggcgctgacggtcggcccgggcatggacatgccgatcatgcacgacagcgaccgctacgagctggtgcgggacatcggctccggcaacttcggcgtcgcccgcctcatgcgcgaccgccgcaccatggagctcgtcgccgtcaagtacatcgagcgcggggagaagatagacgagaatgtccagcgtgagataattaaccatagatcactgaaacatcccaacatcattaggtttaaggaggttattttaacaccgacccatcttgctattgtcatggaatatgcatctggtggtgagctttttgagagaatatgtaaaaatatacgattcagtgaagatgaggctcgctacttcttccagcagcttatatctggagtcagctactgccattcgatgcaagtatgtcaccgtgacttgaagctggagaacacattgctggacggtagtcctgctcctcgcttgaagatatgtgatttcggctattctaagtcttcagttctccattcacaaccaaaatcaactgttggaacacctgcttatattgcacctgaagttctgttgaagaaagaatatgatggcaagattgctgatgtatggtcctgtggtgtgactctttatgtcatggtagtcggtgcttatccttttgaggatccagaagagcctaagaactttcggaagacaattcagcgtatcttgagtgttcagtattcaattccagataacgtggacatatctccagagtgcaggcacctaatttcgaggatttttgttggggatcctgcgttgaggataaccatccctgaaatacggagccataactggttcttaaagaacctccccgctgatctgatggacgatgatagtatgagcagccagtatgaggaacctgatcagccaatgcaaaccatggatcagatcatgcaaattctaacggaggccaccataccacctgcttgttctcgtataaaccacatcctaactgatggattcgacatggacgatgacatggatgaccttgaatcagactcagatcttgatatcgacagcagtggagagatcgtgtatgcgatgtgagccatcgaccaacaagagaactgaaggggcagggtgccctgatgtgtaccttgtcaaagtactagcagccctttgtgaaaagaatcgttctgtattttgcttagtttcttgccgtggaaccccagcgatgttcccatgaactcatgatgctgttgtaattgaactggggttacttccctg

SEQ ID NO: 468 - DNA, 872 bp, Hordeum vulgare
cctcgggtctgcagsgtcccaaatccaatacccaggatacaaactgttctgagtctctgcacatcagtcttcgcccccactgattcgttcgtccagccgagaagaagaagagctgcagaagcagaagagaagatgagcaagctctggaccatcctcacccacctccacaccctcgcagggcctggggtgatgctcctgtatcccttgtatgcgtcggtgcaggcgatggagagcccgtccaagctggacgacgagcagtggctggcctactggatcctctactccttcgtcacgctcgtcgagatggtcctcgagtccctcatctactggataccgatctggtacgagctgaagctgctgttcctggcgtggctggcgctgcccaacttcaggggagcggccttcatctacgacaggttcgtcagggagcagctcaggaagcacggcctcaccaaccaccccggcagcggcatcagcagcaagaaggagaacggcggcagggtcgacaagtcgtcctcgccgtcgacgtctcccaaggagaaggagaacgccaagagcagattcctctccttcgtcgcacccaagaaagatcactgagatgtgagattggagcagcaaccagagcatccctctgcggctagctttgatggcttgtactagtttgtttgagatttttagcttgtggtgttggagtatcttgtccaaaaaaaattgtgctacgactcactccatatatgaggcccatggttgcaggctagctagatggtggcttgtggtgtcctggtgttgtagtacgtattacatatctgtccagaaaaatgtagtactcagaggtttcatctcattctgatctcattcctgcgtcttaatct

SEQ ID NO: 469 - DNA, 874 bp, Hordeum vulgare; identical to SEQ ID NO: 59

SEQ ID NO: 470 - DNA, 1156 bp, Zea mays
ggtacccccgggctcggccgggaaacggctcagcgccccctcccctgaaacaccacccaaacccaagcagagaagcagagacacatttggctcactcactcacactcactcgctcatagattgtcctgtccgtccatcatctctagctagcagcttccagtgagagcggcaagcgacaccacaaccagacaacacaccaccaccgagctgtgagaagaagttcgcagacaggatgggcaagctgtggacgatcctcactcacctccactccctagcagggccaacggtgatgctgctgtaccctctgtacgcgtccgtgcgggcgatggagagcccgtccaagctggacgacgagcagtggctcgcctactggatcctctactccttcgtcacgctcatggagatgctcctcgagtccctcatatactggatccccatctggtacgagctcaagctgctgttcatcgcgtggctcgtgctccccaacttcaggggcgccgccttcatctacgacaagttcgtgcgcgagcagctccggaagcacggcctcaccgccgccggctccgtcaagtcgtcgtcgccgtcgtccaaggacaaggacaagcccaagaacaagttcctcgccttcgtcacgcccaagaaggatcatgaagcttactgaagtgggttgcagtgatcccattcctggaccatgtcccggcaacctgtagctgtagtgcactccactagatttctgttgtgtttgttctcgacttgaaatagagcctgtacgatgtgtgtatggccattctgtatgtgtgagcatcaactctaacatggaatggagacaagtgccaactttcggtgctgatgatgatgtgaatgtgtgaaatttatgtcattatacagtgttytaggcagacttttcactccgaataatttgtctgccttctctctctctctctctctgaaaacggctgtgtttttgttgctaggtccgaaatcttatgattaggtgcaaatttggagggagtcattaaaacatcaattaatattgtttcctaatggcctgtctccatgggccaaaaataagcccaaccctggtggccaatttcatataccagttgtagtttgtaatatacacacaccagtatgtacaatgagtataagttatggt

SEQ ID NO: 471 - DNA, 896 bp, Oryza sativa
ttccctagtaaatcaaagaacacaaagcatccaaaacaacaccaggaaacttcttttcaatcgatcactccactggtgagtagtgagtggctagtgactggtcagttcatcacttgtgaaggttttgcaatcaggaaaagttcagaagatcatgggcaagctctggacaatcctcactcacgttcattcccttgcagggcctaccgtcatgctcctgtaccccttgtatgcgtcggtgcaggccatggagagcccatcgaagcttgacgacgagcagtggctggcctactggatcctctactccttcatcaccctcgtggagatgcttctcgagtccctcatctactggataccgatctggtacgagctgaagctgctgttcatcgcgtggctggcgctgcccaacttcaggggagccgcgttcatctacaacaggttcgtcagggagcagctcaggaagcatggcctcgccggcgccggcgccggcgccgccgccagcgtcggcaagaaggacaagtcgtcgccgtcgtcgtcacccaaggacaaggagaagaccaagagcaagttcctctccttcgtcactcccaagaaggatcatgaagcttactgagccaagaagtgctgatcagtcggatccctgaagatagttttttagtgtgtgtactgttccatttgtgtttgtccctcttcctctccttcagaagaggcagctagctagcttcatgtttggctggtctttttggccatctgtgcatgtctgtaaactttattggagtgaggggaaaaaagagcataattagttgctccatgttgagttgttagagtggtttcttgtaaatgtaattcaggatctcagatgagcagacaataaaaacacactgttccaggagtgacct

SEQ ID NO: 472 - DNA, 923 bp, Oryza sativa; identical to SEQ ID NO: 62

SEQ ID NO: 473 - DNA, 834 bp, Saccharum officinarum
catcacccaaacccaagcaagcaaaacacatttggctcactcacagtcactcactcatctgtccgtccrtcatctctagctagcttccagtgaaagctgcaagcgacagcacaaccagctgagaagaaggttgtagaagatgggcaagctctggacgatcctcactcacctccactcccttgcagggccaacggtgatgctcctgtaccccttgtacgcgtcggtgcaggcgatggagagcccgtccaagctggacgacgagcagtggctcgcctactggatcctctactccttcatcacgctcatggagatggtcctcgagtccctcatctactggatcccgatttggtacgagctgaagctgctgttcatcgcgtggctggcgctccccaacttcaggggcgccgcgttcatctacgacaagttcgtgcgggagcagctccggaagcacggcctcacctccgccgccgcctccggcaagaaggacgacggcaagtcgtcgtcgccgtcgtccaaggacaaggacaagcccaagarcaagttcctcgctttcgtcacacccaagaaggatcatgaagcttactgaagcagggtgcagtgatcccatccctggaccatgtcccggcaacctgtagtgtattcccctagatttctgttgtttggttttgttcttctcttgaaatagagttgttcgatgtgtgtatggccatcctctatgtgtgaacatcaacttcaacatggaatggagacgagacgacctttcggtgttgatgatgtgaatktktkwastttawgtcaatatatgcagtgttctgggacagacttttcactctg

SEQ ID NO: 474 - DNA, 1176 bp, Triticum sp.
  misc_feature (1168)..(1168): n is a, c, g, or t
  misc_feature (1176)..(1176): n is a, c, g, or t
tcgcggccgcgtcgacccaaaatccaaacccaagccaagaacacacgctgttctgaatctgtccatcagtctccgcttccactgattcgtccagccgagaagaagaagagctgcagaagatgagcaagctctggaccatcctcacccacctccacaccctcgcagggtatgtgcagcagattgatgratttgttttcccttcggttcttgtttgtgcagttcttgctgagctcaactgaccatttcatgctcttctctgctgctgctgcaggcctggcgtgatgctcctgtacccgctgtatgcgtcggtgcaggcgatggagagcccgtcgaagctggacgacgagcagtggctggcctactggatcctctactccttcgtcacgctcgtcgagatggtcctcgagtccctcatctactggtaattaaccagcmagaaaatcaaccaagctcatggccgcttttcttgatttctgccatggttttgatgttaaccgtggtggcttactctgcttctcactctcaggataccgatctggtacgagctgaagctgctgttcctggcgtggctggcgctgcccaacttcaggggagcggccttcatctacgacaggttcgtcagggagcagctcaggaagcacggcctcaccaaccaccccggcagcggcatcagcagcagcaagaaggagaaggcagcaaggaggagaacggcggcaaggtcgacaagtcgtcctcgccgtcgacgtctcccaaggagaaggagaacgccaagagcaggttcctctccttcgtcgctcccaagaaagaccactgaaggagattggagcagcaaccagagatcccagcagctagcttcttggcttgtggtgttttcttggtttgtttgagattttagattgtggtgttgagagtatttacatatcttgtcagaaaaaaattgtactacgactccatatatgaggccctcggttgcaggctagctagatggtgggtggcttgtggtgttgtagtattacatatctgtccaaaaaaatgtagtaccgagattggagcagtaaccagagatttcatctcatctcatccttccggctaagctagcttgtggtgttcatttctgagatttagctagctgatttgatgtgaagcttactaaaaacctcggccgcgnacacgctn

SEQ ID NO: 475 - DNA, 1634 bp, Arabidopsis thaliana; identical to SEQ ID NO: 425

SEQ ID NO: 476 - DNA, 1289 bp, Arabidopsis thaliana; identical to SEQ ID NO: 426

SEQ ID NO: 477 - DNA, 1074 bp, Arabidopsis thaliana; identical to SEQ ID NO: 424

SEQ ID NO: 478 - DNA, 1503 bp, Arabidopsis thaliana
gaaactattacttaaataataaaaaaataagagccatcgtgacttcgagagaagaagccagcaaggaacgatggagattattacggcatcatcatcatcatcatcatcatttggaaattaggcttgttgtttgatttcgctacgagaaaatggacaagtacgagcttgttaaagacatcggtgctgggaattttggagtggcgaggctcatgagagtcaaaaactccaaggaactcgttgctatgaagtacatcgagcgtggacctaagattgatgagaacgtggcgagagagattattaaccacagatcacttcgtcatcccaatattatccggtttaaggaggtggttttgacaccaacgcacatcgccattgctatggaatatgctgctggcggtgagctatttgagcgtatatgtagcgctggaagattcagtgaggatgaggcaagatactttttccagcagcttatctcaggagtcagctattgtcatgctatgcaaatatgccacagagatctgaagcttgaaaataccctcttagatggaagtcctgctccacgcctgaagatctgtgattttggttattccaagtcctcactgttgcactctatgcccaaatcaactgttggaactccagcatatattgcacctgaggttctttctcgcggagagtatgatggcaagatggctgatgtatggtcttgtggtgtgactctttatgtcatgctggtgggagcatacccatttgaagaccaagaggatcccaaaaacttcaaaaaaacaatacaaagaataatggctgtcaagtacaagatcccggactatgtccatatctcacaagattgcaaacatctcctctcccgtatatttgtcaccaactcgaataagaggattacgataggtgacatcaagaaacatccatggttcctaaagaacctgccaagggaacttacagaaatagctcaagctgcatacttcaggaaagagaacccgacattctcactccaaagcgtcgaagagataatgaagattgtggaagaggcaaaaactccagctcgtgtttctcggtcgattggagcatttgggtggggaggaggagaagatgccgagggcaaggaggaagatgcagaggaagaagttgaggaagtagaagaagaagaagacgaagaagatgagtatgataagacggtgaagcaagtgcatgctagcatgggagaagtccgagtcagttaaaaaaaaagattgattttcttttcacgaaagtattctaaaaccaaaaaaaaaagaaaaaaaagttttcgttggtctgtcgaatttgtctcttgctctgtgttgagttcttattttcttttcttggtcataatttttaaggttagtctcataaatgctttggaattttgcttctgaaaatcttgtaaaatctgcagtagaagaaagaacaaactggtttgatgataagttcggtttgggcgaataaaatattttgtatattatatggtct

SEQ ID NO: 479 - DNA, 1525 bp, Arabidopsis thaliana
  misc_feature (1442)..(1442): n is a, c, g, or t
  misc_feature (1453)..(1453): n is a, c, g, or t
  misc_feature (1465)..(1465): n is a, c, g, or t
  misc_feature (1470)..(1470): n is a, c, g, or t
agaagccagcaaggaacgatggagattattacggcatcatcatcatcatcatcatcattgtaattcgtaatcatatcttcttttggaatttcttcacggataagaaaaaaggatatcgacaatttcgcttttgctttcaaaatctcattctatcactttgtgccttttttagccatcgcgaaaaacctctgaatcgcatcccttgattttctgggtttgtgactttgtgtagtggaaattaggcttgttgtttgatttcgctacgagaaaatggacaagtacgagcttgttaaagacatcggtgctgggaattttggagtggcgaggctcatgagagtcaaaaactccaaggaacttgttgctatgaagtacatcgagcgtggccctaagattgatgagaacgtggcgagagagattattaaccacagatcacttcgtcatcccaatataatccggtttaaggaggtggttttgacaccaacgcacatcgccattgctatggaatatgccgctggcggtgagctatttgagcgtatatgtagtgctggaagattcagtgaggatgaggcaagatactttttccagcagcttatctcaggagtcagctattgccatgctatgcaaatatgccacagagatctgaagcttgaaaataccctcttggatggaagtcctgctccacgcctgaaaatctgtgattttggttattccaagtcctcattgttgcactctatgcccaaatcaactgttggaactccagcatatattgcacctgaggttctttctcgcggagagtatgatggcaagatggctgatgtatggtcttgtggtgtgactctttatgtcatgctggtgggagcatacccatttgaagaccaagaggatcccaaaaacttcaaaaaaacaatacaaagaataatggctgtcaagtacaagatcccggactatgtccatatctcacaagattgcaaacatctcctctcccgtatatttgtcaccaactcgaataagaggattactatagctgacatcaagaaacatccatggttcctaaagaacctgccaagggaacttacagaaatagctcaagctgcatacttcaggaaagagaacccgacattctcactccaaagcgtcgaagagataatgaagattgtggaagaggcaaaaactccagctcgtgtttctcggtcgattggagcatttgggtggggaggaggagaagatgccgagggcaaggaggaagatgcagaggaagaagttgaggaagtagaagaagaagaagacgaagaagatgagtatgataagacggtgaagcaagtgcatgctagcatgggagaagtccgagtcagttaaaaaaaaaaaagtttggttttcttttcacgggagtattctaaaacccaaaaaaaaaaaaaggttttcgttggtctctcggaattggnctcttgctctntgttgagttctnatttncttttcttgggccataatttttaaggggtagcccccaaaaatccttttggaattt

SEQ ID NO: 480 - DNA, 1683 bp, Arabidopsis thaliana
taaactattacttaaataataaaaaaataagagccatcgtgacttcgagagaagaagccagcaaggaacgatggagattattacggcatcatcatcatcatcatcatcattgtaattcgtaatcatatcttcttttggaatttcttcacggataagaaaaaaggatatcgacaatttcgcttttgctttcaaaatctcattctatcactttgtgccttttttagccatcgcgaaaaacctctgaatcgcatcccttgattttctgggtttgtgactttgtgtagtggaaattaggcttgttgtttgatttcgctacgagaaaatggacaagtacgagcttgttaaagacatcggtgctgggaattttggagtggcgaggctcatgagagtcaaaaactccaaggaactcgttgctatgaagtacatcgagcgtggacctaagattgatgagaacgtggcgagagagattattaaccacagatcacttcgtcatcccaatattatccggtttaaggaggtggttttgacaccaacgcacatcgccattgctatggaatatgctgctggcggtgagctatttgagcgtatatgtagcgctggaagattcagtgaggatgaggcaagatactttttccagcagcttatctcaggagtcagctattgtcatgctatgcaaatatgccacagagatctgaagcttgaaaataccctcttagatggaagtcctgctccacgcctgaagatctgtgattttggttattccaagtcctcactgttgcactctatgcccaaatcaactgttggaactccagcatatattgcacctgaggttctttctcgcggagagtatgatggcaagatggctgatgtatggtcttgtggtgtgactctttatgtcatgctggtgggagcatacccatttgaagaccaagaggatcccaaaaacttcaaaaaaacaatacaaagaataatggctgtcaagtacaagatcccggactatgtccatatctcacaagattgcaaacatctcctctcccgtatatttgtcaccaactcgaataagaggattacgataggtgacatcaagaaacatccatggttcctaaagaacctgccaagggaacttacagaaatagctcaagctgcatacttcaggaaagagaacccgacattctcactccaaagcgtcgaagagataatgaagattgtggaagaggcaaaaactccagctcgtgtttctcggtcgattggagcatttgggtggggaggaggagaagatgccgagggcaaggaggaagatgcagaggaagaagttgaggaagtagaagaagaagaagacgaagaagatgagtatgataagacggtgaagcaagtgcatgctagcatgggagaagtccgagtcagttaaaaaaaaagattgattttcttttcacgaaagtattctaaaaccaaaaaaaaaagaaaaaaaagttttcgttggtctgtcgaatttgtctcttgctctgtgttgagttcttattttcttttcttggtcataatttttaaggttagtctcataaatgctttggaattttgcttctgaaaatcttgtaaaatctgcagtagaagaaagaacaaactggtttgatgataagttcggtttgggcgaataaaatattttgtatattatatggtctattttgc

SEQ ID NO: 481 - DNA, 1573 bp, Hordeum vulgare; identical to SEQ ID NO: 427
  misc_feature (26)..(26): n is a, c, g, or t

SEQ ID NO: 482 - DNA, 1545 bp, Hordeum vulgare; identical to SEQ ID NO: 428
  misc_feature (26)..(26): n is a, c, g, or t

SEQ ID NO: 483 - DNA, 1671 bp, Hordeum vulgare; identical to SEQ ID NO: 430

SEQ ID NO: 484 - DNA, 1437 bp, Hordeum vulgare
cggcacgaggggccgacgtctctcgagttcgcccccatcctcatccctcatcgcccccccacctcgagtatccccagcgggttccggaacccagtaacaccgtcctgctccctactacaccctcccgctgcctgcttcttttgagagagagagagagagagagagagagagagctggagcgaccaggaggaggcagaggggaaggatggatcggtacgaggtggtgagggacatcgggtcagggaacttcggggtggcgaagctggtgcgggacgtcaggaccagggagcacttcgccgtcaagttcatcgagcgaggccacaagattgatgaacatgttcaaagggagattatgaaccatcggtcactcaagcatccaaatattattcgattcaaggaggtagtgctaactcccacacatttggcaatagttatggaatatgcctctggcggtgagctttttcaaaggatttgcaatgcagggagattcagcgaggatgagggaaggttcttcttccaacaactgatttctggagtgagctattgtcactcgatgcaagtatgtcatagagatttgaaactagagaatacgctcttggatggtagtgtcgctcctcgactcaagatttgtgacttcggttactccaagtcttctgtcttgcactctcaaccgaagtcgactgttggcacaccagcatacatcgctccggaggtcctctctagaagagaatatgatggaaaggtcgctgatgtttggtcttgtggagtaacgctctatgtgatgctcgtcggggcatatcctttcgaggaccctgatgagccgaggaacttccgcaaaacgatcgcaaggatactcagcgtacagtactccgttccggactacgttcgagtctcgatggattgcatacatctgctgtcccgcattttcgttggaaatcctcagcagcgaataaccatcccggagatcaagaaccacccatggttcctcaaaagactgcccgttgagatgacagacgagtaccaaaggggcatgcagttggcagacatgaacacgccgtcgcagagcctggaagaagccatggcgatcatccaggaggcgcagaaaccgggcgataacgccctagggcttgctgggcaggttgcctgcctggggagcatggatctagacgacattgatttcgacgtcgacgacattgacattgagaacagcggggacttcgtgtgcccgttgtgatgctgatgggtttagaagttcttggtggtttagctgtggatggatccctgtttgtcgtgcttcgattttcttccggatcacatattttctgtgggctgcacagatcggccttgccgtgtagaaaccagtatgagacaagtttacatgcgaatatcgaaatcactagttaaggaatacaaaaacaaaaaaagctcgtgcactcg

SEQ ID NO: 485 - DNA, 1437 bp, Hordeum vulgare
cggcacgaggggccgacgtctctcgagttcgcccccatcctcatccctcatcgcccccccacctcgagtatccccagcgggttccggaacccagtaacaccgtcctgctccctactacaccctcccgctgcctgcttcttttgagagagagagagagagagagagagagagagctggagcgaccaggaggaggcagaggggaaggatggatcggtacgaggtggtgagggacatcgggtcagggaacttcggggtggcgaagctggtgcgggacgtcaggaccagggagcacttcgccgtcaagttcatcgagcgaggccacaagattgatgaacatgttcaaagggagattatgaaccatcggtcactcaagcatccaaatattattcgattcaaggaggtagtgctaactcccacacatttggcaatagttatggaatatgcctctggcggtgagctttttcaaaggatttgcaatgcagggagattcagcgaggatgagggaaggttcttcttccaacaactgatttctggagtgagctattgtcactcgatgcaagtatgtcatagagatttgaaactagagaatactctcttggatggtagtgtcgctcctcgactcaagatttgtgacttcggttactccaagtcttctgtcttgcactctcaaccgaagtcgactgttggcacaccagcatacatcgctccggaggtcctctctagaagagaatatgatggaaaggtcgctgatgtttggtcttgtggagtaacgctctatgtgatgctcgtcggggcatatcctttcgaggaccctgatgagccgaggaacttccgcaaaacgatcgcaaggatactcagcgtacagtactccgttccggactacgttcgagtctcgatggattgcatacatctgctgtcccgcattttcgttggaaatcctcagcagcgaataaccatcccggagatcaagaaccacccatggttcctcaaaagactgcccgttgagatgacagacgagtaccaaaggggcatgcagttggcagacatgaacacgccgtcgcagagcctggaagaagccatggcgatcatccaggaggcgcagaaaccgggcgataacgccctagggcttgctgggcaggttgcctgcctggggagcatggatctagacgacattgatttcgacgtcgacgacattgacattgagaacagcggggacttcgtgtgcccgttgtgatgctgatgggtttagaagttcttggtggtttagctgtggatggatccctgtttgtcgtgcttcgattttcttccggatcacatattttctgtgggctgcacagatcggccttgccgtgtagaaaccagtatgagacaagtttacatgcgaatatcgaaatcactagttaaggaatacaaaaacaaaaaaagctcgtgcactcg

SEQ ID NO: 486 - DNA, 1496 bp, Hordeum vulgare
cttcctcccccccgcccccgcccccgcccggccccctcctcgctcgggtgcttcctccctccctcctggtgtccactccactcgccactggctccrctcggwwcttgaatcttggccgacctacctgagccggcagccaccggtagcccgccaccgcttcttgctccagtgccgtctacgagctgcggacggacggagggggtccgggatggagcggtacgaggtgatcaaggacatagggtcgggcaacttcggcgtggccaagctggtccgggacgtccggaccaaggagctctttgccgtcaagttcatcgagagggggcacaagattgatgagaatgttcaaagggagattatgaaccacagatctctgaggcatccgaacattgttagattcaaagaggttgtgctaactcccacacatttggccatagttatggaatacgctgctggcggcgagctattcgaaaggatctgcggttctggaaaatttagtgagaatgaggctaggttcttcttccagcaattgctttcaggagttagctattgccattccatgcaaatatgtcatagagatttgaaactagaaaatacgctcctggatggcagcgaagcgccccggctcaagatatgtgatttcggttactccaagtcctctgtgttgcactcccagccaaaatcaaccgtaggtactcctgcctacattgcccccgaggtcctttctagaagggaatatgatggaaaggtcgccgatgtctggtcctgtggagtaactctatatgtgatgcttgtcggtgcttatccttttgaggacccagacgaaccgaagaatttccgcaagacaattactaggatactcagtgtacaatactcagtacctgattacgtccggatttcaatggagtgcagacatttgctgtcccggattttcgtggcaaaccccgagcaacgaataacaatccaggagataaagaaccacccgtggttcctcaagaatctgccgatcgagatgaccgacgagtaccaaatgagcctgcacatggtcggcgtcaacgcgcccccgcagagcctggaggagatcatggccatcatccaggaggcccggataccgggcgacggatccaagttcgccgggcagctgtcggtgcccgggctagggagcatggagctcgatgatatagacgacgtcgacgcggacgtcgaggacagcggagacttcgtgtgcgcattgtgacgagcaggcgtgatggtttccctctggtggtgtggcctttgtgtttgtaatgggttcatccttctgttgtgtcgtttgtttcagagggttgcgctgtgctgttgtatgattacatgtgttttctgtaaccgttgttggtagtgacgctgtggataaagtataagtataactatactttcatgtgtgtttggtgtcctcagctggattcctggtaatttgcttctctttgtacttcggcggtttatattagttttggtttttg

SEQ ID NO: 487 - DNA, 1428 bp, Hordeum vulgare
cttcctcccccccgcccccgcccccgcccggccccctcctcgctcgggtgcttcctcctccctccctcctggtgtccactccactcgccactggctccactcggaacttgaatcttggccgacctacctgagccggcagccaccggtagcccgccaccgcttcttgctccagtgccgtctacgagctgcggacggacggagggggtccgggatggagcggtacgaggtgatcaaggacatagggtcgggcaacttcggcgtggccaagctggtccgggacgtccggaccaaggagctctttgccgtcaagttcatcgagagggggcacaagattgatgagaatgttcaaagggagattatgaaccacagatctctgaggcatccgaacattgttagattcaaagaggttgtgctaactcccacacatttggccatagttatggaatacgctgctggcggcgagctattcgaaaggatctgcggttctggaaaatttagtgagaatgaggctaggttcttcttccagcaattgctttcaggagttagctattgccattccatgcaaatatgtcatagagatttgaaactagaaaatacgctcctggatggcagcgaagcgccccggctcaagatatgtgatttcggttactccaagtcctctgtgttgcactcccagccaaaatcaaccgtaggtactcctgcctacattgcccccgaggtcctttctagaagggaatatgatggaaaggtcgccgatgtctggtcctgtggagtaactctatatgtgatgcttgtcggtgcttatccttttgaggacccagacgaaccgaagaatttccgcaagacaattactaggatactcagtgtacaatactcagtacctgattacgtccggatttcaatggagtgcagacatttgctgtcccggattttcgtggcaaaccccgagcaacgaataacaatccaggagataaagaaccacccgtggttcctcaagaatctgccgatcgagatgaccgacgagtaccaaatgagcctgcacatggtcggcgtcaatgcgcccccgcagagcctggaggagatcatggccatcatccaggaggcccggataccgggcgacggatccaagttcgccgggcagctgtcggtgcccgggctagggagcatggagctcgatgatatagacgacgtcgacgcggacgtcgaggacagcggagacttcgtgtgcgcattgtgacgagcaggcgtgatggtttccctctggtggtgtggcctttgtgtttgtaatgggttcatccttctgttgtgtcgtttgtttcagagggttgcgctgtgctgttgtatgattacatgtgttttctgtaaccgttgttggtagtgacgctgtggataaagtataagtataactatactttcatgtgtgtttgg

SEQ ID NO: 488 - DNA, 1530 bp, Hordeum vulgare
acgaggaattaatcgaacccatcccagcgaagaagaggaggaggaagaagaagcctctccttctcctttaagcttcgaatcatccttccccttccctcccacttcatctcgccgcgacgaagcttccaaaaccccccaaaaggatcccccaatcttcgcctctgcctccggcccgatcaatctctcagcagcggatagcgctcggctaggccccgggatccatggagaggtacgagctgctcaaggacatcggcgccggcaacttcggcgtcgcccggctgatgcgtaacaaggagaccaaggagctcgtcgccatgaagtacatcccacgaggcctcaagattgatgagaatgtggcgagggagatcataaaccaccggtcgctgcggcaccccaacataatccgattcaaggaggtggtggtcacgccgacgcacctggcgattgtgatggagtacgcggccggcggcgagctcttcgaccggatctgcaacgccgggaggttcagcgaggacgaggccaggtacttcttccagcagctcatctgcggcgtgagctactgccacttcatgcaaatttgccaccgggacctgaagctggagaacactctgctggacggcagcccggcgccccgcctcaagatctgcgacttcggttactcaaagtcgtcgctgctgcactcgaagcccaagtcgacggtcggcacgccggcgtacatcgccccggaggtgctctcccgccgggaatacgacggcaagacagccgatgtgtggtcttgtggagtgaccctttatgtgatgctagtcggcggttacccttttgaggatcctgatgaccccaagaatttcagaaagaccatcgggagaataatgtcaatccaatacaaaataccggagtacgtccacgtatcccaagactgcaagcaactccttgccagtatttttgttgcaaaccctgcaaagagaataacaatgagggagatcaggaaccacccctggttcttgaagaacttaccaagggagctcacggaagctgcccaagcaatgtactacaagagagacaacagcgccccaacctactcggtccagtccgtggaggagatcatgaagattgtcgaggaggcgcagaaaccgcctccttccaccactccggtagcaggtttcgggtgggcggaggaggacgagcaggaggatggcaagaagccggaggaagaggcggaggaggacgatgaggaagacgagtatgagaagcagttgaatgaggtccgtgccagcggtgagttccacatcagctagctgatgggggtgcttcactggcgtgagaaggccacagaccggggataaaatttgtcatatagtttgtagtttgtggttttgttctcgagtttttctcttcattcttgtctctgattctgcaacagtgtaaattaccaaagtggttccgtcgccgtctttacaatgactgattaagttagcatgcggaaacataatgtatggaataaatcatcttattgagcatgttcttgcagtt

SEQ ID NO: 489 - DNA, 2038 bp, Gossypium sp.; identical to SEQ ID NO: 436

SEQ ID NO: 490 - DNA, 1958 bp, Gossypium sp.; identical to SEQ ID NO: 435

SEQ ID NO: 491 - DNA, 2609 bp, Gossypium sp.
caaataacactacgatttcattcctcattcacctgcaatccatagtcaacttaatcctgtaaagttacatgcatagtttagtgctcaagtttgagatgttatagtctagaacatcaatatttttagcaatgaaacaaaagttattggctatagaacaatcttaaagccataaagccaggacttttattacacaactgttggatgaagattacatttgcttaatggatttgatattctccacttgcatggacttccttcacccgcttatcgtattcatcttcttcgtcgtcttctttcacttccccatcgatgtcttcctcctcatcatcgtcttggccccaaccaaagcccttgacaggcactgatgctggaggtggaattcttgcctcttccacaattttcattatctcatctatactttgaagagaaaatgtagggttatcgctccggtaataagcagcttgtgctgtgtctgttagctctctgggcaagttcttcagaaaccaaggatggttttttatttccttaagtgtgatcctcctggaaggattggcaacaaatatccgagagagtaggttcttgcaatcttgagatatatgaacgtagtctggaattttgtactgaacggccattattctctgaattgttttccgaaaattcctagggtcagcttggtcttcaaaagggtaagctcccaccaacataacataaagggtaactccacaggaccatacatctgccaactttccatcatactctcgccgcgccagaacttccggtgctatatatgctggagttccaactgttgatttgggtcttgaatgcaacagagatgacttagagtaaccgaaatcgcagattttcaaacgaggtgcaggacttccatctaaaagggtattttctaatttcaaatctctatggcatatttgcatggagtgacagtaattgacaccagagatcaactgctgaaaaaaatatctagcctcatcttcactgaatctaccagcagtgcaaatccgatcaaagagctcaccaccagcagcatactccatcacaattgctaaatgggtaggcgtcaaaaccacctccttgaaccggattatattagggtgtctaagagatctgtgattgataatctctcttgccacattctcatctatcttgtgacctctctcaaatatatttcatagcaacaagctccttggtatccttgtgtctgagaagttgagcaaccccaaaattgccggctcccaaatctttgaccacctcatatttctccattttacctcaataactactactactactactactactagtagaatgatattgcttccatttttgtcattacatattaagcaatattgcttaaagataaatatggacagatccatctgcagctaggtatccattactccagcttaggcaataaagaagggcaagtgaataataaattcacatatctaccattttttttttaaattcacgtcaatgttataaaattaaagaaaccaaattatactaaattaaaatcaaatgataacagagggactaaaaccataatcagaccgtaataaaaatcaatcattcttgcctgaaatgatgaaaatatccagagtcaaacacatttctatccagtaggaaatgagaaaaatcatatcaattaaaaaaaacaaatatccagagtcaaacacattggttgaggctttttttttatgttttcttactaaaatcctcgattttttataataataataataataataataatagcaaaatcatatcaattaaaaaaaaacaaatagctttaaaatataacataaaatgaacatagtcataaactcatgctgaagtaaaaagctagcaataagaatattttccatacacacttcttctctttgcttcagtgagcaaaaaaaccagttagcaaaagtagcaaccaaatgctacctgatgaactaatctcagcttaacgaagctcaatagtttcaaattcttagctaattaaaattcgaagctaaaaacaacatgaaaaaaatgataaaagaaggcaaataaaggaagcttaaataataataaaaattaataaaagtgagaaagaagagatgaacctaaaatccgaaaggctaacttgaaggattttaatagcttgtgacctcgtcacatatctcgcagcaattccttcctttttctttcccggaggtcggtacatgctgaatggtgagccaataggggggtgacttcaccagatggtagattgtcccattatagctttgtttgagaaatttgtgatgtgggactaaccaaacttcgtctctctcactttttattctctgtttaacaaacaaggctttttgtttttctgcaacagaatatgaaaaatagattgataaaagggaaaaaaaaccctctattaaaccctctatgaagaaggagaaggggcaacgattgttcctcaacgagaataggcccacttcagagttcaccgatggcgagtttctttccggctagggtttcgacggacacgcggctgcgcgacgggatctagcagttcccatagaccgtgaactcccattttagggtgctcagtaagaattaggtgttttgag

SEQ ID NO: 492 - DNA, 1723 bp, Gossypium sp.
ttttaataatgaaaatgttacttaaaaattatattggtaatttcttaaattttatggagtcgcaactctagacataacataccactttatgatggaagaaatcaaacttataggactcatagatgacagatcttccattttactctaaaaagtgtagaccactacatttacccaacttaccaactaggcaggcttcaaatccctgtagtttccacctacctaatcagtaccaatacaccctacaaaatcatattagagactgcacaaacttcttgtccaaaacacactaatttacaggttgtttattcaacacccaggtcctatagcaaaaaactgacatcatatttataagaacatatgtaagcactaaaagacaccaaaactccatctttggaaaccatatattactctcttttttccttaagagacgtgaatttctccactggcatgtacctcttttaccgttttctcgtactcatcttcttcgtcttcttcttctacttcttcttctgcatcttcttcctttgcatccccatcttcttctccaccccagccaaagcctccgatagaccgtgatactcgaggggcaactttggcctcttcaactattttcatgatttcatcaacactttggagggagaacgtcgggttttctttcctgtagtaagcagcttgagctgcctctgtcagttccctgggcaggttcttcaaaaaccacggatggctcttgatatctttgatgctgatcctcctggaggggctagcaacaaatatgcgagaaaggaggtgtttgcaatcttgggatatgtgaacatagtctgggattttgtattgaactgacattatcctactaatagttttcctaaagttcttaggatcctcttggtcctcaaatgggtatgcaccaaccaacataacgtaaagagtcaccccacaagaccatacatctgccatcttgccatcatattctctccgagaaagaacttctggtgcaatatatgcgggagttccaacagttgacttgggtcttgaatgcagtagagatgactttgaataaccaaaatcacagattttcagacgaggagcagggctcccatccaacagggtattctctaacttcagatctcgatggcatatttgcatggcatgacagtagctaactcctgagatcaactgctgaaaaaaatacctagcctcatcctcgctgaatcgtccagcgttgcaaattcgctcaaagagttcaccaccagctgcatactccatcacaattgcaagatgtgtaggagtcaaaaccacctctttgaaccgaattatattcggatgacgtagtgatctatgatttataatctcccttgccacattctcatcaatcttttgtccacggtcgatatacttcatggcgacgagttctttggtttctttgttacgcatcaacctcgctacgccgaagttcccagatcctatgtctttcaccagctcgtacttgtccatcttttattttcttttcctttttcccttttcctttacaaataaatcaagataaatcgaaaaccctaactcaattattcacaaatcgtaacaggtaacaattaatacaaacacattataaatcggaaattcgcggcggtggccgaagtggcggaagtagcggtggagattggagagatttgaaggaaagtaaaaggaatattgaaaaaaaattcaaatcatgacagagcaaaat

SEQ ID NO: 493 - DNA, 1189 bp, Gossypium sp.
  misc_feature (14)..(14): n is a, c, g, or t
attattcatactgncaatgcacagacaaaatcaccacttgtctctatatcatctatatctgcatcagtatctaagtcatcaagctccatactaccaccaagtaattgactcccaatttttggaccctcaccaggttctctagcctcttcaattatagacaacacttcttcaatactttgaaactgttcatcttcttccttttccaggtttcctccctctcctcccatgaattcctttggcaagtgctttaaaaaccagggatgctgcttgatttctggtatggttattctcttttcagggtctgctacgaaaatccttgataggagatgtctgcaatcctttgaaagtcgaacataatcaggaatagaatagtggacactcagaatccgctgaattgtttttctaaagtttcttggatcttgagggtcttcaaaaggataagcgccaaccagcatgacatacaaagtaaccccacatgaccaaacatctgcaatcttcccatcatattcttttttggacaagacctccggtgcaatataggctggggttcctacagttgatttgggctgggaatgtaacacactcgacttagagtagccgaagtcacatatttttagtctgggtgtactgctcccatctaatagagtgttttccagcttaagatctctatgacaaattttcattgcatggcaataactcactcctgatatcagttgttgaaagaaaaaccttgcctcatcttcaccaaatctaccagcgttgcatattctttcaaaaagttctccaccagctgcatattccatgactatggcaagatgagttggtgttaacaggacctctttgaattttattatatttggatgcttcaaagacctatggttcataatctccctttgcacatgctcatcaatcttggggcctctttcaatatacttgacagcataaagctcaccagtccttttatccctaaccagcttagcaacaccaaagttccctgatccaatatctttcagtatctcataacgctccattttccaaacccaaaaactcccagcaaatatgtgaggaaagaaacagcagcacttatatgaatcttatatagttgcagcaaatatataaaaccttttgtgtaaatttttttttcttatatttggtttagtgttggaggaatgtgccatgattttcaagg

SEQ ID NO: 494 - DNA, 1766 bp, Gossypium sp.
taaaataatggtcaaataaaataattgacaaacctgtttttctcttcataaatgcactgatttttgccgtctttcaaagactctaaaaaaaaattccatattctttactttccttcaaatctctccaaatctccgcatccaccgtcacctccgccgtccaccgccgctacgtgtttcgattcgtaatgtgttgaatgtaaatcgatacgtgcttggatttgtgaataattgagttagggttttgatttatctgatttatttaaaagaagaacaaaaatatggagaagtacgagctggtgaaagacataggatctgggaactttggtgtagcgaggctgatgcgtaacaaggaaaccaaagaacttgtcgccatgaagtatatcgaccgtggccataagattgatgagaatgtggcaagagagattataaatcatagatcgcttcgtcatccaaatataattcggttcaaagaggttgttttgactcctacacatcttgcaattgtgatggagtatgctgctggtggtgagctctttgagcgaatttgcaacgctggaaggttcagtgaagatgaggccagatattttttccagcagctgatctcaggagttagctactgtcattccatgcaaatatgccatcgagatttgaagttagagaatactttgttggatgggagccctgctcctcgtctgaaaatctgtgatttcggttactcaaagtcatctttgctgcattcaagacccaagtcaactgtcggtactcctgcttatattgcaccagaagttctttctcggagagaatatgatggcaagatggctgatgtatggtcatgtggagtgactctttacgttatgttggttggtgcttacccatttgaggaccaagaggatccaaagaattttaggaaaactattagtagaataatgtcagttcaatacaaaatcccagactatgttcatatatctcaagattgcagacacctactttctcgcatatttgttgctagcccctccaggaggatcagcatcaaagatatcaagagccatccgtggtttttgaagaacctgcccagggaactgacagaggcagctcaagctgcttactacaggaaagaaaacccgacgttctccctccaaagtgttgatgaaatcatgaaaatagttgaagaggccaaagttgcccctcgagtatcacggtctatcggaggctttggctggggtggagaagaagatggggatgcaaaggaagaagatgcagaagaagaagtagaagaagaagacgaagaagatgagtacgagaaaacggtaaaagaggtacatgccagtggagaaattcacgtctcttaaggaaaaaagagagtaatatatggtttccaaacgatggagttttggtgtcttttagtgcttacatatgttcttataaatatgatgtcagttttttgctataggacctgggtgttgaataaacaacctgtaaattagtgtgttttggaccagaagtttgtgcagtctctaatatgattttgtagggtgtattggtactgattaggtaggtggaaactacagggatttgaagcctgcctagttggtaagttgggtaaatgtagtggtctacactttttagagtaaaatggaagatctgtcatctatgagtcctataagtttgatttcttccatcataaagtggtatgttatgtctagagttgcgactccataaaatttaagaaattaccaatataatttttaagtaacattttcattatt

SEQ ID NO: 495 - DNA, 1854 bp, Gossypium sp.
  misc_feature (1753)..(1753): n is a, c, g, or t
  misc_feature (1760)..(1760): n is a, c, g, or t
  misc_feature (1770)..(1770): n is a, c, g, or t
  misc_feature (1772)..(1772): n is a, c, g, or t
  misc_feature (1774)..(1774): n is a, c, g, or t
  misc_feature (1806)..(1810): n is a, c, g, or t
  misc_feature (1818)..(1818): n is a, c, g, or t
  misc_feature (1820)..(1821): n is a, c, g, or t
aacaatctttaaatgatatttcatattataatggggagttgtaaaattttaaacgagtcaaacattctggcataccattttatgatggaaaagaaatcagcttacaagactcgcataccctccattatactctaaagtctagacattaacaacccacaattatgaagttgatcccaattgggtaaagcttcaaatcccagtagttccaacttccgactttcaatagcaacacaacctaaacaatcataaaaagactgcacaaacatctttggcccaataccataatttacagtttgtttattcgacaccaggtcctaggtagaaaccgacatcatatgaacacaaggactaaacacagaactcgaattgaaaagcatatactaacaagttttaagagacatgaacttctccactagcatgtacctcctttactgtcttctcgtactcatcttcttcttcctcttcttcttgctctgtatcttcttcccttgcatccccatcttcttctccaccccagccaaagccaccaatagaccgtgatactggaggagctactttcgcttcttcgactattttcatgatttcatcaacagattgaagggagaaagttgggttttctttcctatagtaggcagcttgagctgcctctgtcagttccctgggcaagttcttcaaaaaccatggatggctcttgatatcttttatggagatcctcctggaggggctagcaacaaatatgcgagaaagtaggtgtctgcaatcttgagatatatgaacatagtctgggattttgtattgaactgacattattctactaatagttttcctaaaattctttggatcctcttggtcctcaaatgggtaagcaccaaccaacataacgtaaagagtcactccacatgaccatacatcagccatcttgccatcatattctctccgagaaagaacttctggtgcaatataagcaggagtaccgacagttgacttgggtcttgaatgcagcaaagatgactttgagtaaccgaaatcacagattttcagacgaggagcagggctcccatccaacaaagtattctctaacttcaaatctcgatggcatatttgcatggaatgacagtagctaactcctgagatcagctgctggaaaaaatatctggcctcatcttcactgaaccttccagcgttgcaaattcgctcaaagagctcaccaccagcagcatactccatcacaattgcaagatgtgtaggagtcaaaacaacctctttgaaccgaattatatttggatgacgaagcgatctatgatttataatctctcttgccacattctcatcaatcttatggccacggtcgatatacttcatggcgacaagttctttggtttccttgttacgcatcagcctcgctacaccaaagttcccagatcctatgtctttcaccagctcgtacttctccatatttttgttcttcttttaaataaatcagataaatcaaaaccctaactcaattattcacaaatccaagcacgtatcgatttacattcaacacattacgaatcgaaacacgtagcggcggtggacggcggaggtgacggtggatgcggagatttggagagatttgaaggaaagtaaagaatatggaatttttttttagagtctttgaaagacaacaaaaatcagtgcatttatgaagagaaaacaggtttatcaattattttatttgaccattatttttttctttttgatcggccgaatntttggtnccggtagttncncntgcaggagggcgttatccacccctattgtccnnnnnaaaaaaancnnatggcccctgggccccccgcccccccgcggcgc

SEQ ID NO: 496 - DNA, 1641 bp, Gossypium sp.
cgttaaattcggctttcgagcggccgcccgggcaggtacgcggggaagcttataaaaagttagctggttaggtggtcttctacctttcaaggactgtttctttacagttttcctttttgttttgtctattttggaatatatagagcatatttcttggtcttggtcttactgtttaagaactcttagaaagaaaattttctcttttcataggtttttgatctctaaaastcttgtttttagtgtaagttttcacattttctttttaattccttttctcccccccttttttttttgtggtgtgatcgatggaggagagatatgasccagtgaaggagcttggatcagggaattttggagtcgcaaggctggtgaaagataagaagacaaaagagcttgttgccgtcaaatatattgaaagaggaaagaagattgatgagaatgttcagagagaaatcattaaccaccgatctttacgacatccaaacataatcwggtttaaagaggttgtggtgactccaacacatttagctattgtcatggagtatgctgccggcggtgaactcttcgagagaatatgcagtgcaggtcgatttagtgaagacgaagctaggtttttcttccagcagctaatatctggtgtcagctactgtcattccatgcaaatttgtcacagggatctgaaactagaaaacacactcctggacggaagtccaacaccacgtcttaaaatatgcgactttggttactccaagtctgcagtgctgcattcacaaccaaagtcaactgtaggaacaccagcgtatatcgccccggaagtcctatcacgaaaggaatacgatggaaagatgtttggtcttgtggcgtgacattatacgtgatgttggtgggagcatacccttttgaggatcccaaagatcctcggaatttccgtaagaccatcggacgaataatgagtgtccaatacactatacccgactatgtacgagtgtccgcggattgccggcagcttctttcctgtatcttcattgccaatcctgccaagaggattagcatcccagagattaaggagcatccttggtttctgaaaaatttaccgaaagaattagtcgaaatcgaaaaaacgaactatgcrgaatcggtacgtgaccaaccatctcaaagtgttgaagaaataatgcgtatcatacaagaggctaagacaacaacagccgaaggagccaaagttggtgagcaagctgctgccggttcatccgatccygatgatgtggaggcagatttagaatccgaaatcgatgtcagtggtgactttgaagctcctatgtgagaacctgatgttaactgcttcaacaggatttgtgcatcgaggtttggagtgttakttggattacagtttagatatggtttttatcrtactgggaaaatgttgtacagcagacattaacactggatcggtgttgccttgctttgtattaccttggtttagtgtctcatgttgtacatttcatactttgtgaagcatctttcagaaatgatttcaaagcttgtatgtattgttttgcactacttcggactgtaacaatgttatgattgtattttataattaatccacctataacttatacttgtggtcgacgcggccgc

SEQ ID NO: 497 - DNA, 1371 bp, Vitis sp.
gggggctgatacagtgaagggatttgagaggaaatagatagtgggattgttaacaatggagaagtatgaaatggtgaaggatcttggatctggcaactttggtgttgccaggttgatgagggtcaaggagaccaaagagcttgttgccatgaaattcattgagcgtggccacaagatagatgaaaatgtggccagagagattataaatcatagatcgcttcggcacccgaatataatcaggttcaaggaggtggttctgactcccactcatttgggtattgtgatggagtacgctgctggtggtgagctcttcgagcgaatctgcaatgccggtagattcagtgaagatgaggctagatatttcttccagcagctgatttcaggtgtcagttactgccattcaatgcaaatttgtcatagagatttggagctggaaaatacgcttttggatggaagccctgcaccacgcttgaaaatctgtgattttggttactctaagtcatctctgctgcactcaaggcccaaatcaacggtaggaacgccagcatatatagcacctgaagttctttctaggcgagaatatgatggcaagttggcagatgtatggtcttgtggagtgactctctatgttatgctggtgggagcatacccttttgaagacccggatgaccccaaaaactttagaaaaacgattgggcgaatcatggccgttcaatacaaaattccagaatatgttcacatatctcaagattgcaaacagcttctttcccgcatttttgttgcaaattcctccaggagaattacaattaaagaaatcaagaaccacccctggttcttaaaaaacttgccaagggagctaacagagtctactcaagccaactatcaccaaagagacaacctgagcttctctcttcaaagtgttgaggagataatgaaaattgtgggggaggcgagaattcgttgtccatcatctaggtccattgggggctttgggtggggagcagaagagggtaaaggcggtgaggacgatctagacgtagaggaggaagaaatagaagaagaagacgagtacgacaagagggttagggaagtccatgcaagcggagaatttcacgttagttaagcagtgtattccccctctaataaggtattagatgaacaaaattttcatttttgtgatgttagaatcattatatttgtgtgtacaaatggtaattatttactccttgaaactcatcagattatagcgaattttaatatttgaactaaaatactgttgtatgtttttttaacttattcagctggtggacatgtaatctatttattcctctttggatcaaatgtatgagaagatggttgtcttgttactgg

SEQ ID NO: 498 - DNA, 1374 bp, Vitis sp.
gggggctgatacagtgaagggatttgagaggaaatagatagtgggattgttaacaatggagaagtatgaaatggtgaaggatcttggatctggcaactttggtgttgccaggttgatgagggtcaaggagaccaaagagcttgttgccatgaaattcattgagcgtggccacaagatagatgaaaatgtggccagagagattataaatcatagatcgcttcggcacccgaatataatcaggttcaaggaggtggttctgactcccactcatttgggtattgtgatggagtacgctgctggtggtgagctcttcgagcgaatctgcaatgccggtagattcagtgaagatgaggctagatatttcttccagcagctgatttcaggtgtcagttactgccattcaatgcaaatttgtcatagagatttggagctggaaaatacgcttttggatggaagccctgcaccacgcttgaaaatctgtgattttggttactctaagtcatctctgctgcactcaaggcccaaatcaacggtaggaacgccagcatatatagcacctgaagttctttctaggcgagaatatgatggcaagttggcagatgtatggtcttgtggagtgactctctatgttatgctggtgggagcatacccttttgaagacccggatgaccccaaaaactttagaaaaacgattgggcgaatcatggccgttcaatacaaaattccagaatatgttcacatatctcaagattgcaaacagcttctttcccgcatttttgttgcaaattcctccaggagaattacaattaaagaaatcaagaaccacccctggttcttaaaaaacttgccaagggagctaacagagtctactcaagccaactatcaccaaagagacaacctgagcttctctcttcaaagtgttgaggagataatgaaaattgtgggggaggcgagaattcgttgtccatcatctaggtccattgggggctttgggtggggagcagaagagggtaaaggcggtgaggacgatctagacgtagaggaggaagaaatagaagaagaagacgagtacgacaagagggttagggaagtccatgcaagcggagaatttcacgttagttaagcagtgtattccmcctctaataaggtattagatgaacaaaattttcatttttgtgatgttagaatcattatatttgtgtgtacaaatggtaattatttactccttgaaactcatcagattatagcgaattttaatatytgaactaaaatactgttgtatgttyttytaacttattcagctggtggacatgtaatctatttattcctctttggatcaaatgtatgagaagatggttgtcttgttactggcca

SEQ ID NO: 499 - DNA, 1680 bp, Vitis sp.
ccccctttttaaggcatcttgctaccgtgttgaatctgaataatttatgttacatttctttgtactttccccctcccttagttgagtttgagctttaactaactgcctgtaccatttgtccatatggacttttatagaatgttcaacaaaaacaaaaaaccctcatctcaagttctcaacccattcagtactgcaatcacattgctgcagtgaccaccaaagttatggcttgtctcatacttcaaatacatcatatacaatattatttgtaaaataataaagtctagagtctagaccattaatacatgctaaaacttgttcagactatcttgatcgatgtaattccttggctcatgcaggctcacacaggggccatgaactccccgctgacatcaatttcarattccaaatcggcctccaagtcatcagagtctaatgctccatctagactgtgcccatcaactttggatccttcccctggtgtccttgcttcttgaatgattcgcattatttcttcaacactttgaaccagttggtcatggtgcaattccccgtagttagttttctccccttcaatgagctccttgggaaaatttttaagaaaccaaggatgttgttttatctctgggatggtgatcctctttaagaaggattgacataaacaggattagtctgtcatcatgagtcaattgtgtttcagatacttcatgraaacgaaatgaatccatccattttaattttgttagcatttgaaaggattttataaaaactctatgtcaagtgttataagaaacaaaataagctcatttcagatactttgaaaaacaaaatggaatcttgtcatttccattgaaatgccttaatgattccaagagagtgatgaaagatgcaattcaatatttgctttagaggatgttacctttgcaggattcgcaacaaaaatacgggaaaggagctgcctgcattctgcagatacatgtacatagtcgggtatggagtactggacactcattattctcccaatggtcttccggaaatttctaggatcttcaggatcctcaaaagggtaggctcccaccaacatcacatataaagtcacaccacaagaccaaacatctgcaatctttccatcatactcctttcgcgacaggacctcaggggcaatgtatgctggagttccaactgctgatttgggttgtgagtgcaacaaagcagacttggaatagccaaagtcgcatattttaagccgtggcattggacttccatccaggagtgtgttctccagtttcagatctctatgacaaatttccatagaatgacagtagctcactccggatattagctgctggaagaaaaatctcgcctcatcttcactaaaccgaccagcgttgcatatcctctcaaagagttcaccaccagctgcatattccatgacaatggccaaatgcgttggagttaacaagacctccttgaacctgacaatatttggatgtctcaaggatctgtgattgatgatttccctctgcacattttcatcaatctttttccctctctcaatatacttgactgcaacaagctccttcgtcttcttgtccctcaccagccttgccaccccaaaattcccagacccaagctccttcaatgcatcgtacctctcctccatctaacccacaatcaaac

SEQ ID NO: 500 - DNA, 1682 bp, Zea mays; identical to SEQ ID NO: 438

SEQ ID NO: 501 - DNA, 1894 bp, Zea mays; identical to SEQ ID NO: 439

SEQ ID NO: 502 - DNA, 2112 bp, Zea mays
ccctcgaggccggccggggcagccctatcgtcgtcttcggttcgtctcttctgttgctgggctcgtcgcgagggtagcakwggsyasmtgagggacagagcgaagagagagaaactgaagaaacaacattttccgtttttcttgcttagtgaaaccagtggaagagggagagaaaagaagacgaagacgacaatataagtaaataaaaaaaaggcagcgagcgaggtggaggtggggggaaaagggcgaggtgacaccgtgacagagagaaggcgagggagggatcacgaggtgtgcttcctcctccgcccaatcctgcccaaccaaatccgccagcgccgcctcctttacactcccacctctgtcccggagcaaaaaaaggagggagaggctcgcttcttggatcgcggggtcacgggacgcgcgccgcgggccggtacgctgctgctggcggactgctcgacccttgcctaccagctgctgcctgctgctgcttccttggctggcgccggcgagagacggaggcgaggcgaggcgaggcgacgacgatggaccgggcggcgctcaccgtgggcccggggatggacatgcccataatgcacgacggcgaccgctacgagctcgtccgcgacatcggctccggcaacttcggcgtcgcgcgcctcatgcgcaaccgcgccgacggccagctcgtcgccgtcaagtacatcgaccgaggcgagaagattgacgagaacgtgcagcgggagatcatcaaccaccgctcgctgcgccaccccaacatcatccgcttcaaggaggtcatcctcaccccgacgcacctggccatcgtcatggagtacgcctccggcggggagctcttcgagcgcatctgcaacgccggcagattcagcgaggacgaggcgcgtttctttttccagcaactcatatcaggggtcagctactgccattccatgcaagtatgccatcgcgacttgaagctagagaacaccctgttggacgggagcaccgcgcctcgcctcaagatatgtgattttggctactcaaagtcatcagttctacactcgcagccgaaatctacagtgggaactcctgcatacattgctcctgaggttcttctgaagaaggaatacgatggraaggttgctgatgtgtggtcatgtggagtaacgctctacgtgatgctggtcggcgcgtatccattcgaggacccagacgagcctaagaatttcaggaagacgatccaggttctctctccgcagacgcgcgcgtttattacatccagtgttccaaaaccgccgacgagattattcttgtcttgcagagaatactgggcgtgcagtactcggttccagactacgtccacatatctccggaatgccaggacctaatctccaggatcttcgtcgccaacccgtccaccaggatcaccatgcccgagatacggagccacccttggttcctgaagaacctcccggccgacctggtggacgacagcgcgacgacgacgagcaagcagtacgaggagcccgagcagccgatgcagggcatggacgagatcatgcagatcctgggcgaggccaccattccggcggcggggtcccgcgggctcaaccagttcctgaacgacggcctggacctcgacgacgacatggaggacctggactcggacgccgacctcgacctggagagcagcggggagatcgtgtacgctatgtgacggcgccgagtgctcagcgacgaggcaatgtctcgttgcgctcgcaggttgccgagataactagagagacggagagggtgggtgtgtgctgctgctgcctgcagcctgcgtgtagttgtgtgctttcaggtctctgctgctcatgcctgatgccgtcgttcgtgatggcccctttttaccgtcctgttgtgtttggccgttgttatttggtgcgccttcagtgcagtgttttgcaacggtttagccatttggaatcgctactgctacaacctcgttcatccgagaggaccctttgtttctgcatccccagcgatgtacttgtattactacactgtatcatatgttatatttggtgtaggaaaataaaggaactccattgcccgttctctgtc

SEQ ID NO: 503 - DNA, 1685 bp, Zea mays
cacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtaatttctcagacatcttggaaaggaaatgttctggtacgaatttgaagttggatgattggtagctacacacgtaagtgtcttcaaactgttacttttgatgcttttaaagaagaaaaatacagactttttatattctttgcctgttgaacgagatgtttgagccacacttgtgaacattgtgctggtgactgcacgttcttagaaccccattcatttaccactaatacgtatctctcattttttttaataaaggagttgtctttgtcttgtacttatctctatgacattctttccattcatcattggacacctgctttagactgattgtcaaggtctaatcatcacaaaccatttctaggttgaaaattaaagtagtacttagtttttcaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattcctatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcagagaataaccattcctgagatcaagaagcacccgtggttcctcaagaatctgcccatcgagatgaccgacgagtaccagcagagcatgcagttggcagacatgaacaccccggggcaaagcctggaggaggcgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttggtcgttggtgtctgtagatccttgttgtgctatgcttccattcgttcctggatcagatatgttgttgtgtaaccgagaaaattggcgttgctgtggacaatagaaacagacccataaacttatgcggaaatctacccccc

SEQ ID NO: 504 - DNA, 2044 bp, Zea mays
ttggggacmtygrgccsgmggccggccgkgcmgggaacctcagactcctcccggaccagctgacctccgctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtaatttctcagacatcttggaaaggaaatgttctggtacgaatttgaagttggatgattggtagctacacacgtaagtgtcttcaaactgttacttttgatgcttttaaagaagaaaaatacagactttttatattctttgcctgttgaacgagatgtttgagccacacttgtgaacattgtgctggtgactgcacgttcttagaaccccattcatttaccactaatacgtatctctcattttttttaataaaggagttgtctttgtcttgtacttatctctatgacattctttccattcatcattggacacctgctttagactgattgtcaaggtctaatcatcacaaaccatttctaggttgaaaattaaagtagtacttagtttttcaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattccatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcaggtacactttttctaatcttgaaattatttagcttacaaggacagacctagtgttagaggctctcacatggatagagtctatagagaagatcgagacaagccttttggccgcacatgcggagaggcggcttcaaatctgtgagctagtgactcagttcttaccactgtatcagacctgtccttctaagtgacaatctgtatcatctttcaccttacactcataatttgcgtcgccgcagagaataaccattcctgagatcaagaagcacccgtggttcctcaagaatctgcccatcgagatgaccgacgagtaccagcagagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttggtcgttggtgtctgtagatccttgttgtgctatgcttccattcgttcctggatcagatatgttgttgtgtaaccgagaaaattggcgttgctgtggacaatagaaacagacccataaacttatgcggaaatctaccccccmaaaaagaaaaaaaatcctctgtgatctgttgaattagaac

SEQ ID NO: 505 - DNA, 1325 bp, Zea mays
tcccggaccagctgacctccgctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattccatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcagagaataaccattcctgagatcaagaagcacccgtggttcctcaagaatctgcccatcgagatgaccgacgagtaccagcagagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttggtcgttggtgtctgtagatccttgttgtgctatgcttccattcgttcctggatcagatatgttgttgtgtaaccgagaaaattggcgttgctgtggacaatagaaacagacccataaacttatgcggaaatctaccccccc

SEQ ID NO: 506 - DNA, 2000 bp, Zea mays
cattgggtacctcgaggccggccgggccgggaacctcagactcctcccggaccagctgacctccgctccattcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtaatttctcagacatcttggaaaggaaatgttctggtacgaatttgaagttggatgattggtagctacacacgtaagtgtcttcaaactgttacttttgatgcttttaaagaagaaaaatacagactttttatattctttgcctgttgaacgagatgtttgagccacacttgtgaacattgtgctggtgactgcacgttcttagaaccccattcatttaccacttatacttatctctcattttttttaataaaggagttgtctttgtcttgtacttatctctatgacattctttccattcatcattggacacctgctttagactgattgtcaaggtctaatcatcagaaaccatttctaggttgaaaattaaagtagtacttagtttttcaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattccatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcaggtacactttttctaatcttgaaattatttagcttacaaggacagacctagtgttagaggctctcacatggatagagtctatagagaagatcgagacaagccttttggccgcacatgcggagaggcggcttcaaatctgtgagctagtgactcagttcttaccactgtatcagacctgtccttctaagtgacaatctgtatcatctttcaccttacactcataatttgcgtcgccgcagagaataaccattcctgagatcaagaagcacccgtggttcctcaagaatctgcccatcgagatgaccgacgagtaccagcagagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttgatcgttggtgtctgtagatccttgttgtgctatgcttccattcgttcctggatcagatatgttgttgtgtaaccgagaaaattggcgttgctgtggacaacagaaacagacccataaacttatgcggaaatctaccccccc

SEQ ID NO: 507 - DNA, 2475 bp, Zea mays
cattgggtacctcgaggccggccgggactgggccggacactattataaaaataaaaaaaaaaaagattaaaactccggccctatcaaaagctggccccttccacagcgcactccctcaccttcctccacggctccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaaacaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggactacttggtggcaacttgtttctatgggtgttggatacttggatgtctatcagcattcagcagctatgggtagcatgcactagtgccatgccccttgagtcggggaagtgcttatggcatttgggcctcggagttttttttgccaataactcatatttgttgagtggctatrrkgcaatgactgagtgacagttccttagcagttagcagtctgctttgtcctcttgttcttctgttatatattcttgtttgcacggaatgcatgccactgttttttgtgctacctgatttgccgtcgataaaagaggtatcaactaggtagagtgaaggagaattatcgctggatggtaatatcaaccaaaaatatcgaacttcggtccatagactgaattccttttaacttgtttttttctctcgccaggatttcatagcagcacacctttaagaaatgtttctcgcaactaagttctttggaatgtaattagctacaacaagcatgggtcaattatgattctggcagtaacttgtattcctttcaactagtttggctgcagtaccggagaaatacttagtgtactggtcattgacgacagtaaatttcgtggatttaattggagacctctttataatgctaacaacatagttatctcatgaagcttattactgcagaaaatagcaggagagggtccaaccgtgattattacatttttgtttcagaatttaaatttattaccatttccaaactacaaattaaaagagaggcttagtttttcaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgctgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcctgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggataaataatagacgttatgtgttgtattcttgctgaattgttgttcagctccttctgtttgccctgtatgaactgggcagtttcatgagtaccacaatgtgtatgttgatggctctgtcttcccttgtctc

SEQ ID NO: 508 - DNA, 1604 bp, Zea mays
cctatcaaaagctggccccttccacagcgcactccctcaccttcctccacggctccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaaacaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgctgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcctgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggataaataatagacgttatgtgttgtattcttgctgaattgttgttcagctccttctgtttgccctgtatgaactgggcagtttcatgagtaccacaatgtgtatgttgatggctca

SEQ ID NO: 509 - DNA, 1544 bp, Zea mays
cctcctctcccctcccctgtcgagtccggctgtccccacgacccccacgccacgcgctctctcccgctcctcgcaacggcaaaaccccagcgaattccccacgcgcccgccagctcggcggcggcccagggatccatggagaagtacgagctgctcaaggacatcggctccggcaacttcggcgtggcgcggctcatgcggaacaaggacaccaaggagctcgtcgccatgaagtacatcccgagggggctcaagattgacgagaatgtggcgagggagatcataaaccaccgctcgctgcggcaccacaacatcatccgcttcaaggaggtcgtgctcacgcccacgcacctcgccatcgtcatggagtacgccgccggcggcgagctcttcgaccggatctgcagcgccggcaggttcagcgaggacgaggcgaggtatttcttccagcagctcatctgcggtgtcagctactgccacttcatgaggtgtgcgactgcgaattttgtttggattcattcgcagcaaatttgtcaccgggacttgaagctggagaacacgctattggatggcagcccggcgccgcggctaaagatctgcgactttggctactctaagtcatcgctgctgcattcaaagcctaaatccaccgttggaactccggcgtacatagctccggaggtgctctcccgccgggaatatgacggcaagatggcagacgtttggtcttgtggagtgactctttacgtgatgctggtcggtgcgtacccttttgaggaccccgatgatcccaagaatttcagaaaaacgattgggagaatagtgtcaattcagtaccagataccagagtatgtccacatatcccaagactgcagacagctcctggctcggatcttcgtcgcaaatcctgcaaagagaatcacaattagggagattaggaatcacccctggttcctgaagaatttgcccagagagcttacagaagctgcgcaagcgaagtactacaagaaggacaacagtgcccccaccttctccgatcaaaccgttgaagagatcatgaagattgtagaggaggcccgcacgccaccccagtcatctactccggtggctggttttggttgggctgaggaagaagagcaggaagatggcaagaggtctgatgatgacgagcagtatggggaggatgaggactacgatggcgaggacgagtatgataaacaggtgaagcatgtacatgccagcggcgattttcaacacctcctaaaatgaagctcctggcagcgctcaagtcctcaactggtgagatactgtctggatttgttgtagtttgtggtgctgagatgctgcaccctcggcgcgtacttgtagtttccttctgtctggatccaccttttttttcgcatattgtgtgctatactctgtaaattatcaaactggcttcctcaatgcctatgtaatgaaccgttgagtgattaagatagaaggcgaaatataatttctatggaacataaaaaaaatagaatacataaaagacaatgtaatga

SEQ ID NO: 510 - DNA, 1463 bp, Zea mays
gcgagcaagaggcctcctcctcaagcttcgaatcctccccttccgcgctttccctccccctcctcctcctcccctttccagtccccaccccagcgaagcttccaaagccgccccaaccccaacggccgcccggcccgatcgagcagacagctgccgcggccctccccgccccgcacgcgacctcggagccatggagaagtacgagctgctgaaggacatcggcgccggcaacttcggcgtggcgcggctcatgcggaacaaggagaccaaggagctggtcgccatgaagtacatcccccggggccaaaagatcgacgagaatgtggcgagggagatcatcaaccaccgctcgctgcgccaccccaacatcatccggttcaaggaggtggtgctgacgccgacgcacctggcgatcgtgatggagtacgccgccggcggcgagctgttcgaccggatctgcaacgccgggaggttcagcgaggacgaggcgaggtacttcttccagcagctgatttgtggcgtcagctactgccactccatgcaaatctgccaccgagacttgaagctggagaacacgctgctggacggcagcccggcgcctcgcctcaagatctgcgacttcggttactccaagtcgtcgctgctgcactcgaagcccaagtcgacggtcggcacgccggcgtacatcgcccccgaggtgctctcccgccgggaatacgacggcaagacagccgatgtgtggtcctgtggagtcactctttatgtgatgctggtcggtggttacccttttgaggacccagacgacccaaagaatttcagaaagacgatcgggaggatcatgtcaatccaatacaaaataccagagtatgtgcacgtgtcgcaagactgcaaggagctgctttcaaggatctttgttgcaaactctgcaaagagaataacgatcagggagatcaggaaccacccctggttcctgaagaacctgcccagagagctcacggaggctgcgcaggccatgtactacaagaaagacaacagcgccccgacctactccgtccagtccgtggaggagatcatgaagatcgtggagaaggcgcggacgccgcctccttcctccacccccgtggctggcttcggttgggcggaggaggacgagcaggaggacagcaaggaaccagacgaggaacacgaggacggcgaggacgagtacgagaagcaggtgaagcaagtccacgccagcggggagtttcatctcagctgctgagggttttcgccggcctgctagtctgtggtaccagccgatgatggacctgctagtctgtggtcttgttttcaagttttctttcatttttttctttcttttgctgtggtgccgcatgactgcaacagttgtaaattattgaagggggttccagcgttgcccttgtattgactcattcaagctagcatggggaacataattatgg

SEQ ID NO: 511 - DNA, 1580 bp, Zea mays
actactcctcggagcagcagagctgcagtagtggaattaattaatcgaacccaccccaccggggaagaagaagaagaagaagaagcctctccttctcctttaagcttcgaatcatcctttccttccccctcccccctccctccctcccacttcatctcgccgcgacgaagcttccaaaacccccaaaaggatcccccaatcttcgcctctgcctccggcccgatcaatctctcagcagcggctgccgcgcggctccgcacgcgacctcggagccatggagaagtacgagctgctgaaggacatcggcgccggcaacttcggcgtggcgcggctcatgcggaacaaggagaccaaggagctggtcgccatgaagtacatcccccggggccaaaagatcgacgagaatgtggcgagggagatcatcaaccaccgctcgctgcgccaccccaacatcatccggttcaaggaggtggtgctgacgccgacgcacctggcgatcgtgatggagtacgccgccggcggcgagctgttcgaccggatctgcaacgccgggaggttcagcgaggacgaggcgaggtacttcttccagcagctgatttgtggcgtcagctactgccactccatgcaaatctgccaccgagacttgaagctggagaacacgctgctggacggcagcccggcgcctcgcctcaagatctgcgacttcggttactccaagtcgtcgctgctgcactcgaagcccaagtcgacggtcggcacgccggcgtacatcgcccccgaggtgctctcccgccgggaatacgacggcaagacagccgatgtgtggtcctgtggagtcactctttatgtgatgctggtcggtggttacccttttgaggacccagacgacccaaagaatttcagaaagacgatcgggaggatcatgtcaatccaatacaagataccagagtatgtgcacgtgtcgcaagactgcaaggagctgctttcaaggatctttgttgcaaactctgcaaagagaataacgatcagggagatcaggaaccacccctggttcctgaagaacctgcccagagagctcacggaggctgcgcaggccatgtactacaagaaagacaacagcgccccgacctactccgtccagtccgtggaggagatcatgaagatcgtggagaaggcgcggacgccgcctccttcctccacccccgtggctggcttcggttgggcggaggaggacgagcaggaggacagcaaggaaccagacgaggaacacgaggacggcgaggacgagtacgagaagcaggtgaagcaagtccacgccagcggggagtttcatctcagctgctgagggttttcgccggcctgctagtctgtggtaccagccgatgatggacctgctagtctgtggtcttgtttycragttttctttcatttttttctttcttttgctgtggtgccgcawgactgcaacagttgtaaattattgaagggggttccagcgttgcccttgtattgactcattcaagctagcatggggaacataattatggaataaaacaggtcgttgagcatgctgtaactgc

SEQ ID NO: 512 - DNA, 1892 bp, Zea mays
cattgggaccctcgaggccggccgggcacgtcacccctgtcatcgccgatctcgcgtcgcttggcctccaagtccaggtccatgtccaacagacaaaaaaaaaaccccgcccccggttcgtcacttcgtcgctttctcgtcgagccgcgactgccgactgcgaccgagagaattctctatccggtccccgtccggtttggttagagttcgcactcgtgattgggttggtcgcttggttcttccctgccggaagatacctttcgttcggtgtcgccaactcgccattcttgggaggtcttggtcgggaccggtgctgatggaggagaggtacgaggcgctgaaggagctgggggccggcaacttcggcgtggcgaggctggtcagggacaagcggaccaaggagctggtagccgtcaagtacatcgagaggggcaagaagattgatgagaacgtgcagagggagatcatcaatcaccagtcgctccggcaccctaacatcgtacggttcaaggaggtttgtctaacacccacacatcttgctattgtcatggaatatgctgctggtggagagctatttgagaaaatctgctcagcagggcgattcagtgaagatgaggtttgttttggccttatattcgtcatattgtcagcctattttctcgccccgaaccacgtcaaactaatgttgtgtgctccctatgttgtaaacgcaaacagtccaggtatttcttccaacagctgatatcaggggtcagctactgccattctatggtacggttttgcttccaaaagtcaacaagtccatgaatagtggagtgtaagttttaatgagctaacaaatgaaacacaggaaatttgtcaccgtgatcttaaacttgagaacaccctccttgatgggagtccaacacctcgtgtgaaaatttgcgactttggttactcaaaggtgttgtatacggatactgcgccggctctgttatgcgtcctaactttaccagcaactgacttctcttgtgtcgttgaatcagttacaaactttgctagtgtgcttttcagtctgctttgctgcattccaaaccaaaatcaacagttggaactccagcatacatagcccccgaggttctttccagaaaagagtatgatggaaaggtagcagacgtttggtcctgtggtgtcacgctgtacgtgatgctcgtgggatcatatccatttgaagatcctgaggatccaaggaacttccggaaaacgatcagcagaattcttggcgtgcaatactccatcccggattatgtgagagtgtcttcagactgcagacgccttctgtctcagatattcgttgccgatccttcaaagaggatcacgatcccggagataaagcatcacccgtggttcttgaagaacctcccgagggagatctcggagagggagaaggccaactacaaggacgcggatgccgccgagccggcgcaggccgtggacgagatcatgcggattgttgaggaggccaagacccccggtgacatgtccaaggtggttgacccggcgctgctggccgagatggcagagctggagagcgacgaggaagaggcagacgccgatgacacctactgatcgctcctgcatgcagctcagcagctgctcagtcatggtgtccagtcctttgtgctgcagacatggcgccgccgagcgcccgagcttaacccgtgcgtgtgatgacggatgttgtattgcactctttacgctgtttgtataataaaagtctgtacaacgctgtacaattgcagattgccttgtacagatgaactagcgtgcagtgatatactcagtcccaaattctatgttccaaaacggtttaaataattttattttttagagagatcaaaatagttttaagt

SEQ ID NO: 513 - DNA, 1602 bp, Populus spp
ggttttttattttatttcatttcaaaattactatatttgtttgttgggtttggggctctgtctgtctctctttggtttcctttcactttcaagttcatcatctgggtgtttattctcttgatatttcttcttcattttcactttcggacgtggtgatttctaaatttgttttcttttcctttctttcggtagtggtgtaatttttggcggttagggatggaggagaggtatgagacgattaaggagattggttcagggaattttggagtagcaaggctagtcagggataaaaagacaatggagcttgttgctgttaaatacattgaaagaggaaagaagattgatgagaatgttcagagagagatcatcaatcacaggtctttaaggcatccaaayattgtcaggttcaaagaggtcttgttgactccaacacatcttgcaattgtcatggaatatgcagcaggtggtgaacttttcgyaaggatatgcagtgctggtcgatttagcgaagatgagacaagatttttcttccagcagctgatatctggtgtcagttactgtcattccatggaaatttgtcacagagatctgaaacttgaaaacacacttttggatggaagccccrcaccacgccttaaaatatgtgactttggttactccaagtctgctctactgcactcacaacccaaatcaacagttggaacaccagcatacattgccccagaagtcctgtcacgsaaggaatacgatggcaagatttcagatgtttggtcatgtggtgtaacactatatgtgatgttggttggagcataccccttcgaggatcctgaagatcctagaaatttccgcaagaccatcggtagaataatgagtgttcagtactccataccagactatgtacgtgtatctgcagattgcaagcatctcctttctcgtatttttgttgccaatcccgcaaagaggattaccattccagagattaagcagcacccttggtttcttaagaatttgcctaaagagctcgttgaaattgagaaaacaaacttcacaaaatcagaacgtgaccaacctgcccaaagtgtcgaggagattatgagtatcatacaagaggcaaagacgcctggtgaaggtggcaaagttgctgagcatgcttttgcaggaacctctgatgacttggatgttgatctggattctgaggttgatgtcagtggcgacatcatgccctctttctagtcatcacccacaaattgcatacagagaatgtgcgtatccagattctagtgattttggtgacatgaatttccatatgcatgccatgttatctacattgtaaattatcctgaaccagtgtcacctgggcagtgctaaaacatgtggaatgcgttttgaggtgaagcgcgtactgtttgaagcatgcaccgcctgtrgatttcccagttaagggatttgaagaagttgccttcaagcacatatcatgcatatattttttcttatagtgtttatccgctcgaaacaaatgaagatgatgatctacgactatatggttttataaaccatgctctggttccggaaacatgcattagttgattcttcaagttgcta

SEQ ID NO: 514 - DNA, 1429 bp, Populus spp
ttcaaaattactatatttgtttgttgggtttggggctctgtctgtctctctttggtttcctttcactttcaagtttcatcatctgggtgtttattctcttgatatttcttcttcattttcaccttcggacgtggtgatttctaaatttgttctcttttcctttctttcggtagtggtgtaatttttggcggttagggatggaggagaggtatgagacgattaaggagcttggtacagggaattttggagtagcaaggctagtcagggataaaaagacaatggagcttgttgctgttaaatacattgaaagaggaaagaagattgatgagaatgttcagagagagatcatcaatcacaggtctttaaggcatccaaacattgtcaggttcaaagaggtcttgttgactccaacacatcttgcaattgtcatggaatatgcagcaggtggtgaacttttcgtaaggatatgcagtgctggtcgatttagcgaagatgagacaagatttttcttccagcagctgatatctggtgtcagttactgtcattccatggaaatttgtcacagagatctgaaacttgaaaacacacttttggatggaagccccacaccacgccttaaaatatgtgactttggttactccaagtctgctctactgcactcacaacccaaatcaacagttggaacaccagcatacattgccccagaagtcctgtcacgcaaggaatacgatggcaagatttcagatgtttggtcatgtggtgtaacactatatgtgatgttggttggagcataccccttcgaggatcctgaagatcctagaaatttccgcaagaccatcggtagaataatgagtgttcagtactccataccagactatgtacgtgtatctgcagattgcaagcatctcctttctcgtatttttgttgccaatcccgcaaagaggattaccattccagagatcaagcagcacccttggtttcttaagaatttgcctaaagagctcgttgaaattgagaaaacaaacttcacaaaatcagaacgcgaccaacctgcccaaagtgtcgaggagattatgagtatcatacaagaggcaaagacgcctggtgaaggtggcaaagttgctgagcatgcttttgcaggaacctctgatgacttggatgttgatctggattctgaggttgatgtcagtggcgacatcatgccctctttctagtcatcacccacaaattgcatacagagaatgtgcgtatccagattctagtgattttggtgacatgaatttccatatgcatgccatgttatctacattgtaaattatcctgaaccagtgtcacctgggcagtgctaaaacatgtggaatgcgttttgaggtgaagcgcgtactgtttgaagcatgcaccacctgtggatttcccagttaagggattg

SEQ ID NO: 515 - DNA, 2326 bp, Oryza sativa; identical to SEQ ID NO: 443

SEQ ID NO: 516 - DNA, 1683 bp, Oryza sativa; identical to SEQ ID NO: 444

SEQ ID NO: 517 - DNA, 1741 bp, Oryza sativa; identical to SEQ ID NO: 445

SEQ ID NO: 518 - DNA, 1577 bp, Oryza sativa; identical to SEQ ID NO: 446

SEQ ID NO: 519 - DNA, 1702 bp, Oryza sativa
tacgccacagcgtatgatgcgtaagatcaccaccaccacctctcgctcatcccaatccccatcacgagcgccccagaatccctcccctccctcgtgcaccgcctcccgtcccatccagctccttcttcttggcgggcgagagatcgatcgagctggctgcgtgtgagcgagttgccacgagcggccaagagattaacggagggggcggaccagcggagcgaggtcgttgaggggatatggagcggtacgaggtgatgagggacatcgggtccgggaacttcggggtggccaagctcgtccgcgacgtcgccaccaaccacctcttcgccgtcaagttcatcgagaggggactcaagattgatgaacatgttcaaagggagattatgaaccaccgatcactgaagcatccaaacataatccggttcaaggaggtcgtgctaactcccacacatttggcaatagttatggaatatgctgctggtggtgagctatttgaaaggatttgcaacgcagggagattcagtgaggatgaggcaaggttcttcttccaacagctgatttctggagtgagctattgtcattctatgcaagtatgccatagagatttgaaactcgaaaatactctcttggatggcagtgtcacacctcggcttaagatttgtgattttggttactccaagtcttctgtcctgcactctcaaccgaaatcaactgttggcacaccggcttacattgctccagaggtcctctctagaaaggaatacgatggaaaggtagctgatgtttggtcatgtggggtaacactctatgtgatgcttgttggtgcgtatccttttgaggaccctgatgacccaaggaacttccgcaagacgatcactaggatactcagtgtacagtattcaattccagactacgttcgagtttcagcggactgcagacatctcctgtcccggattttcgttggaaatcctgagcagaggataactatcccagagatcaagaaccacccatggttcctgaagaacctgcccatcgagatgaccgacgagtaccagaggagcatgcagctggcggacatgaacacgccgtcgcagagcctggaggaggtcatggcgatcattcaggaggcccggaaaccgggcgacgccatgaagctcgccggcgccgggcaggtcgcctgcctggggagcatggatctcgacgacatcgacgatatcgacgacattgacatcgagaacagcggggacttcgtgtgcgccttgtgatcgatagatgccaaattcgatcgatcgatcatcagctggttgaagactgaagtagcggggcagcgagctttctttgtggctgatgtgttgctgtcattcatgcctcgtttttacttctgggatcacatatgctttgtgaccaagagattgccatcgctgtggataaataagatgaatttaattgcatacttagttatattcttggcagagtgcttttgtgctgctgattctgaattttagttgtctgatcatttcttctttatgcaaattactatcgtctctcgcaattgacaaccagcttggagcagattctgttttactatcatctttgcaccgcagagtatggacatatatcgagtgcacatttacatatagggaatgcacttatatgtgtaagtaataatacaatactttggggttcatgtgttatcggataa

SEQ ID NO: 520 - DNA, 1693 bp, Oryza sativa
tacgccacagcgtatgatgcgtaagatcaccaccaccacctctcgctcatcccaatccccatcacgagcgccccagaatccctcccctccctcgtgcaccgcctcccgtcccatccagctccttcttcttggcgggcgagagatcgatcgagctggctgcgtgtgagcgagttgccacgagcggccaagagattaacggagggggcggaccagcggagcgaggtcgttgaggggatatggagcggtacgaggtgatgagggacatcgggtccgggaacttcggggtggccaagctcgtccgcgacgtcgccaccaaccacctcttcgccgtcaagttcatcgagaggggactcaagattgatgaacatgttcaaagggagattatgaaccaccgatcactgaagcatccaaacataatccggttcaaggaggtcgtgctaactcccacacatttggcaatagttatggaatatgctgctggtggtgagctatttgaaaggatttgcaacgcagggagattcagtgaggatgaggcaaggttcttcttccaacagctgatttctggagtgagctattgtcattctatgcaagtatgccatagagatttgaaactcgaaaatactctcttggatggcagtgtcacacctcggcttaagatttgtgattttggttactccaagtcttctgtcctgcactctcaaccgaaatcaactgttggcacaccggcttacattgctccagaggtcctctctagaaaggaatacgatggaaaggtagctgatgtttggtcatgtggggtaacactctatgtgatgcttgttggtgcgtatccttttgaggaccctgatgacccaaggaacttccgcaagacgatcactaggatactcagtgtacagtattcaattccagactacgttcgagtttcagcggactgcagacatctcctgtcccggattttcgttggaaatcctgagcagaggataactatcccagagatcaagaaccacccatggttcctgaagaacctgcccatcgagatgaccgacgagtaccagaggagcatgcagctggcggacatgaacacgccgtcgcagagcctggaggaggtcatggcgatcattcaggaggcccggaaaccgggcgacgccatgaagctcgccggcgccgggcaggtcgcctgcctggggagcatggatctcgacgacatcgacgatatcgacgacattgacatcgagaacagcggggacttcgtgtgcgccttgtgatcgatagatgccaaattcgatcgatcgatcatcagctggttgaagactgaagtagcggggcagcgagctttctttgtggctgatgtgttgctgtcattcatgcctcgtttttacttctgggatcacatatgctttgtgaccaagagattgccatcgctgtggataaataagatgaatttaattgcatacttagttatattcttggcagagtgcttttgtgctgctgattctgaattttagttgtctgatcatttcttctttatgcaaattactatcgtctctcgcaattgacaaccagcttggagcagattctgttttactatcatctttgcaccgcagagtatggacatatatcgagtgcacatttacatatagggaatgcacttatatgtgtaagtaataatacaatactttggggttcatgtgtt

SEQ ID NO: 521 - DNA, 1418 bp, Oryza sativa
actctccttccacaccgcaccactccacgccttcctcctcttctctcgcagtccactcgctggtctctccaattcttggcttctttgctctgctggattagcagcagctgctctgcttcttgctctgcccttgtctttgggctttcagggcggtgtgctgaggccgagcggtttgggcggtctcaagaatcgcttgtgcgtgcgggggagttgtcgtgggaggtggggatggagaggtacgaggtgatcaaggacatagggtcggggaacttcggcgtggccaagcttgtccgggatgtgcggaccaaggagctgtttgccgtcaagttcatcgagagggggcagaagatcgacgagaatgtccaaagggagattatgaaccacaggtcactgaggcatccgaacattgttagattcaaggaggttgtgctaactcccacacatttggccatagttatggaatatgctgctggaggtgagctattcgaaaggatttgcagtgctgggaggtttagcgaggatgaggcaaggttcttcttccagcagttgatttcaggagttagctactgtcattccatgcaaatatgtcatagagatttgaaactagaaaatactctcttggatgggagcatagcacctcggctcaagatatgtgattttggttactcaaagtcctctttgttgcactctcaaccgaaatctactgtcggtactccagcttatatcgctcctgaggtccttgctagaaaagaatatgatggaaaggttgctgacgtttggtcatgtggagtaactctatatgtgatgcttgttggtgcgtacccctttgaggaccctgacgaaccaagaaacttccgcaagacaattactcggatactaagcgtacaatacatggttcctgattatgttcgagtttcgatggaatgcagacatcttctgtcccggattttcgtggcaaacccagagcaacgaattaccattcctgagatcaagaaccacccatggttcctcaagaacctgccgatcgagatgactgacgagtaccagatgagcgtccagatgaacgacatcaacaccccgtcacagggcctggaggagatcatggccatcatacaggaggcgcggaagccgggtgatggctccaaattctccgggcagatcccgggcctagggagcatggagctcgacgacgttgacaccgacgacatcgacgtcgaggacagcggcgacttcgtgtgcgcattgtgacgaggccgtgaacttgctttctcttcttggagtgtgctgctccttttgttgtgctgctgttcatttctgagagctccattctgttgttgtatcagtgtttgtaaacgaggtgctgtggataatctgaactctttaatatgttggtgttcttagctgaattctttgcgtcc

SEQ ID NO: 522 - DNA, 1863 bp, Oryza sativa
tcgcctccgcccgcatcatgaaaagcccccctctcctctcccctcctcctccccttccacaccgcaccactccacgccttcctcctcttctctcgcagtccactcgctggtctctccaattcttggcttctttgctctgctggattagcagcagctgctctgcttcttgctctgcccttgtctttgggctttcagggcggtgtgctgaggccgagcggtttgggcggtctcaagaatcgcttgtgcgtgcgggggagttgtcgtgggaggtggggatggagaggtacgaggtgatcaaggacatagggtcggggaacttcggcgtggccaagcttgtccgggatgtgcggaccaaggagctgtttgccgtcaagttcatcgagagggggcagaagatcgacgagaatgtccaaagggagattatgaaccacaggtcactgaggcatccgaacattgttagattcaaggaggttgtgctaactcccacacatttggccatagttatggaatatgctgctggaggtgagctattcgaaaggatttgcagtgctgggaggtttagcgaggatgaggcaaggttcttcttccagcagttgatttcaggagttagctactgtcattccatgcaaatatgtcatagagatttgaaactagaaaatactctcttggatgggagcatagcacctcggctcaagatatgtgattttggttactcaaagtcctctttgttgcactctcaaccgaaatctactgtcggtactccagcttatatcgctcctgaggtccttgctagaaaagaatatgatggaaaggttgctgacgtttggtcatgtggagtaactctatatgtgatgcttgttggtgcgtacccctttgaggaccctgacgaaccaagaaacttccgcaagacaattactgtgagttacccaacaaccatatatacctatgagatccctcattccatcttgttgacctcagctcatgctgcatcttgatgtgtgggaataaaagttataagatccttgcagcggatactaagcgtacaatacatggttcctgattatgttcgagtttcgatggaatgcagacatcttctgtcccggattttcgtggcaaacccagagcaagtaattcgtctctcaaaccaattgttcctctagaacaaaacattacattttgctctgtcctcaccagtcatttcttgcagcgaattaccattcctgagatcaagaaccacccatggttcctcaagaacctgccgatcgagatgactgacgagtaccagatgagcgtccagatgaacgacatcaacaccccgtcacagggcctggaggagatcatggccatcatacaggaggcgcggaagccgggtgatggctccaaattctccgggcagatcccgggcctagggagcatggagctcgacgacgttgacaccgacgacatcgacgtcgaggacagcggcgacttcgtgtgcgcattgtgacgaggccgtgaacttgctttctcttcttggagtgtgctgctccttttgttgtgctgctgttcatttctgagagctccattctgttgttgtgtcagtgtttgtaaacgaggtgctgtggataatctgaactcttttatatgttggtgttcttagctgaattctttgcgtcctgcctgcttccctttgagctatgtgcagtttcatcagtctcacaatgcattctcaatttctcatgttttgttatcctagctttagggccaatttagtaatctctatatgcgttgcagttgataacaaagttattcattttgttcattgtactgaactctttcccccgaaaagttatcatacaaggagatgcaaactgttgtgagaag

SEQ ID NO: 523 - DNA, 1829 bp, Oryza sativa
gaggaggagagagaaaccgctactaataaataggagtataaaacagaagcctcctcgttaagcttcgaatcctcttccattccctccttcctctcctctcctctccaagaccaagaaccagcaggagcaagcaaggaaggcgccgaattcgatcggagcaggcaggacgggtccgggatcccgcgccgccatggagaagtacgagctgctcaaggacatcgggtcgggcaacttcggtgtggcgcggctgatgcggaacagggagaccaaggagctcgtcgccatgaagtacataccgcgtggcctcaagattgacgagaatgtggcgagggagatcataaaccaccgctcgctgcggcacccaaacatcatccggttcaaggaggtcgtgctcacgcctacccacctcgcgatcgtcatggagtacgccgccggcggcgagctgttcgaccggatctgcagcgccgggagattcagcgaggacgagtcgaggtatttcttccagcaactaatttgcggcgtcagctactgccacttcatgcaaatttgccaccgggatttgaagctggagaacacgctgctggatggcagccctgcgccgcgcctcaagatctgcgactttggctactccaagtcatcactgctgcactcaaagccgaagtcgacggtcgggactcccgcgtacatcgctccggaggtgctctctcgccgggagtatgacggcaagatggcagatgtatggtcttgtggggtgaccctttatgtgatgctcgtcggtgcttacccttttgaggacccagatgatcccaagaatttcagaaaaacaatcggggtaataattcacccacttcagcctctctaaattccaacttcaaacgccacacgaatgtacaaatatattatgctcacatttttattttgcagagaatcgtatcaattcagtacaaaataccagagtacgtccatatatcccaagattgtagacaactcctctctcgaatctttgtcgcgaatcctgcaaagagaataacaataagagagatcagaaaccacccttggtttatgaagaacttgccgcgggagcttacagaagcggcgcaagcgaagtactacaagaaggacaacagtgcccgtacattctcggatcagaccgtcgacgagatcatgaagattgtacaagaggcaaagacaccacctccatcgtcgactccagtggccggtttcggttggaccgaggaagaagagcaggaggacggtaagaatcccgacgacgacgagggagacagggatgaggaggagggcgaggaaggcgatagcgaggacgagtacaccaagcaggtgaagcaagcccatgccagctgtgacttgcagaagagctgataagatgttgagttcaagctttgctgttgccggcaagagggtgtttttgtgcatgtttgtactttgtggtagttgtgggggtgatgagatgtcgcatccttttcgttattagtttgtctttgtagcttttaactttctgttgttgccttgggtcttccttttcttttatcctgttctttttttttatcttgtgatatgttaacaccgtaaattattactaccaaataggctctccagtgcctttgtaatggttggatggttaagatagcaaggttgtatatagcttgtggaataaaccttatttcttgacaagtgtttatttagggagacaatattttttcttttcaccaacgagataagcaacacaaatgtgtatatatgcatgagatctgtttaacctcattccacgtattgaaataatttttttgcctctggacacatagttgaaa

SEQ ID NO: 524 - DNA, 1565 bp, Oryza sativa
gtagcttcgaatcctcttccattccctccttcctctcctctcctctccaagaccaagaaccagcaggagcaagcaaggaaggcgccgaattcgatcggagcaggcaggacgggtccgggatcccgcgccgccatggagaagtacgagctgctcaaggacatcgggtcgggcaacttcggtgtggcgcggctgatgcggaacagggagaccaaggagctcgtcgccatgaagtacataccgcgtggcctcaagattgacgagaatgtggcgagggagatcataaaccaccgctcgctgcggcacccaaacatcatccggttcaaggaggtcgtgctcacgcctacccacctcgcgatcgtcatggagtacgccgccggcggcgagctgttcgaccggatctgcagcgccgggagattcagcgaggacgagtcgaggtatttcttccagcaactaatttgcggcgtcagctactgccacttcatgcaaatttgccaccgggatttgaagctggagaacacgctgctggatggcagccctgcgccgcgcctcaagatctgcgactttggctactccaagtcatcactgctgcactcaaagccgaagtcgacggtcgggactcccgcgtacatcgctccggaggtgctctctcgccgggagtatgacggcaagatggcagatgtatggtcttgtggggtgaccctttatgtgatgctcgtcggtgcttacccttttgaggacccagatgatcccaagaatttcagaaaaacaatcgggagaatcgtatcaattcagtacaaaataccagagtacgtccatatatcccaagattgtagacaactcctctctcgaatctttgtcgcgaatcctgcaaagagaataacaataagagagatcagaaaccacccttggtttatgaagaacttgccgcgggagcttacagaagcggcgcaagcgaagtactacaagaaggacaacagtgcccgtacattctcggatcagaccgtcgacgagatcatgaagattgtacaagaggcaaagacaccacctccatcgtcgactccagtggccggtttcggttggaccgaggaagaagagcaggaggacggtaagaatcccgacgacgacgagggagacagggatgaggaggagggcgaggaaggcgatagcgaggacgagtacaccaagcaggtgaagcaagcccatgccagctgtgacttgcagaagagctgataagatgttgagttcaagctttgctgttgccggcaagagggtgtttttgtgcatgtttgtactttgtggtagttgtgggggtgatgagatgtcgcatccttttcgttattagtttgtctttgtagcttttaactttctgttgttgccttgggtcttccttttcttttatcctgttctttttttttatcttgtgatatgttaacaccgtaaattattactaccaaataggctctccagtgcctttgtaatggttggatggttaagatagcaaggttgtatatagcttgtggaataaaccttatttcttgacaagtgtttatttagggagacaatat

SEQ ID NO: 525 - DNA, 1582 bp, Oryza sativa
  misc_feature (7)..(7): n is a, c, g, or t
cccacgngtccgccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggcatggagaggtacgagctgctcaaggacatcggcgccgggaacttcggggtggcgcggctgatgcggaacaaggagaccaaggagctggtcgccatgaagtacatccctcggggcctcaagattgacgagaatgtggcgagggagatcatcaaccaccggtcgctgcggcaccccaacatcatccgcttcaaggaggtggtggtcacgccgacgcacctggcgatcgtgatggagtacgctgccggcggcgagttgttcgaccggatctgcaacgccgggaggttcagcgaggacgaggccaggtatttcttccagcagctcatctgcggcgtgagctactgccacttcatgcaaatttgccaccgggatttgaagctggagaacacgctgctggacggcagcccggcgccccgcctcaagatctgcgacttcggttactccaagtcgtcgctgctgcactcgaagcccaagtcgacggtcgggacgccggcgtacatcgcgccggaggtgctatcccgccgggagtacgacggcaagacagccgatgtgtggtcttgtggagtgactctttatgtgatgcttgttggtgcttacccctttgaggaccctgatgaccccaagaatttcagaaagaccattgggagaataatgtcaattcagtacaaaatacccgagtacgtccatgtatcccaggactgcaggcaactcctttctagaatttttgttgcaaaccctgcaaagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctgagtatttctgtccagcagcacaggaagattgcaaactggagatattgtcataatgtggcagctgatggtcacactcccattctgtagtttgcagtcttgtttttcttttttcagtttcattttttcttttcttctctttgatgctgcaacagtgtaaattaccaaagtggttctgtcactgtctttgtaatgactgatttaagttagcatgcagaaacataatgtattgaataaaaccatctcattgagcatcttctttctc

SEQ ID NO: 526 - DNA, 1594 bp, Oryza sativa
gttgagtgctcatcaatccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggcatggagaggtacgagctgctcaaggacatcggcgccgggaacttcggggtggcgcggctgatgcggaacaaggagaccaaggagctggtcgccatgaagtacatccctcggggcctcaagattgacgagaatgtggcgagggagatcatcaaccaccggtcgctgcggcaccccaacatcatccgcttcaaggaggtggtggtcacgccgacgcacctggcgatcgtgatggagtacgctgccggcggcgagttgttcgaccggatctgcaacgccgggaggttcagcgaggacgaggccaggtatttcttccagcagctcatctgcggcgtgagctactgccacttcatgcaaatttgccaccgggatttgaagctggagaacacgctgctggacggcagcccggcgccccgcctcaagatctgcgacttcggttactccaagtcgtcgctgctgcactcgaagcccaagtcgacggtcgggacgccggcgtacatcgcgccggaggtgctatcccgccgggagtacgacggcaagacagccgatgtgtggtcttgtggagtgactctttatgtgatgcttgttggtgcttacccctttgaggaccctgatgaccccaagaatttcagaaagaccattgggagaataatgtcaattcagtacaaaatacccgagtacgtccatgtatcccaggactgcaggcaactcctttctagaatttttgttgcaaaccctgcaaagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctgagtatttctgtccagcagcacaggaagattgcaaactggagatattgtcataatgtggcagctgatggtcacactcccattctgtagtttgcagtcttgtttttcttttttcagtttcattttttcttttcttctctttgatgctgcaacagtgtaaattaccaaagtggttctgtcactgtctttgtaatgactgatttaagttagcatgcagaaacataatgtattgaataaaaccatctcattgagcatcttctttctcagaaaag

SEQ ID NO: 527 - DNA, 1515 bp, Oryza sativa
cggtgacggcgacgaagagaatttcatatccctccacctcgccgcctcccttcttcggatttggtctggtttggttggaggttagctcgcctctgattgggttggttgggtggtcggcttcggtctcgaaccgcggcgacttctcctctttgggtttgggtttcgagggggccaatggaggagaggtacgaggcgttgaaggagctcggggccggcaacttcggggtggccaggctggtcagggacaagaggagcaaggagctcgtcgccgtcaagtacatcgagaggggcaagaagattgatgaaaatgtgcagagggagatcatcaatcataggtcgctccggcatcccaatatcattcggtttaaggaggtttgtttgacacccacacacctagccattgtcatggagtatgctgctggtggagaactctttgaacaaatctgcaccgcagggcgattcagcgaagacgaggcaaggtacttcttccagcagctaatatcaggtgtcagctactgtcattctctggaaatttgccaccgtgatcttaaacttgagaacaccctcctggatggaagcccaacacctcgtgtgaagatttgtgactttggttactcaaagtctgctttgctgcattcgaagccgaagtctacagttggtactccagcatacatagcgccagaagttctttcaagaaaagaatatgatggcaaggtagcagacgtttggtcctgtggtgtgacactgtacgtgatgcttgtcggttcatacccgtttgaagatccaggtgatccgaggaatttccgcaaaacgatcagcagaattcttggcgtgcaatactccatcccggactacgtgagggtgtcttccgactgcaggcgccttctatctcaaatatttgttgccgatccttcaaagaggatcacgatccctgagataaagaagcacacgtggtttctgaagaatctgccaaaggagatatcggagagggagaaggccgactacaaggacacggacgccgcccctccgacgcaggccgtcgaggagatcatgcggatcatccaggaggccaaggtccccggcgacatggccgccgccgacccggcgctgctcgcggagctcgccgagctgaagagcgacgacgaagaggaggccgccgatgagtatgacacctactgaccatccatgatccatatgcatccatggtcgttgtgctgcagctgtaaatatgatccggaatatacgtgatcgccagaccaaatgatatgcgtattctgatgcattttctgccgtgtatactctgcaccggattttcctgcagcgtaaataataaagaaaaaaaataattatttgtttgcagtttcgtgtgatcatttggcaaggactattcagtttgcatggtcattttcccagtttattcattgaattatgtaattggattatttgtgctacacttccttgtctttggattatttaaacatattatttgcgcttctcaaaatatttttctatttt

SEQ ID NO: 528 - DNA, 1461 bp, Oryza sativa
tgggatttggtctggtttggttggaggttagctcgcctctgattgggttggttgggtggtcggcttcggtctcgaaccgcggcgacttctcctctttgggtttgggtttcgagggggccaatggaggagaggtacgaggcgttgaaggagctcggggccggcaacttcggggtggccaggctggtcagggacaagaggagcaaggagctcgtcgccgtcaagtacatcgagaggggcaagaagattgatgaaaatgtgcagagggagatcatcaatcataggtcgctccggcatcccaatatcattcggtttaaggaggtttgtttgacacccacacacctagccattgtcatggagtatgctgctggtggagaactctttgaacaaatctgcaccgcagggcgattcagcgaagacgaggcaaggtacttcttccagcagctaatatcaggtgtcagctactgtcattctctggaaatttgccaccgtgatcttaaacttgagaacaccctcctggatggaagcccaacacctcgtgtgaagatttgtgactttggttactcaaagtctgctttgctgcattcgaagccgaagtctacagttggtactccagcatacatagcgccagaagttctttcaagaaaagaatatgatggcaaggtagcagacgtttggtcctgtggtgtgacactgtacgtgatgcttgtcggttcatacccgtttgaagatccaggtgatccgaggaatttccgcaaaacgatcagcagaattcttggcgtgcaatactccatcccggactacgtgagggtgtcttccgactgcaggcgccttctatctcaaatatttgttgccgatccttcaaagaggatcacgatccctgagataaagaagcacacgtggtttctgaagaatctgccaaaggagatatcggagagggagaaggccgactacaaggacacggacgccgcccctccgacgcaggccgtcgaggagatcatgcggatcatccaggaggccaaggtccccggcgacatggccgccgccgacccggcgctgctcgcggagctcgccgagctgaagagcgacgacgaagaggaggccgccgatgagtatgacacctactgaccatccatgatccatatgcatccatggtcgttgtgctgcagctgtaaatatgatccggaatatacgtgatcgccagaccaaatgatatgcgtattctgatgcattttctgccgtgtatactctgcaccggattttcctgcagcgtaaataataaagaaaaaaaataattatttgtttgcagtttcgtgtgatcatttggcaaggactattcagtttgcatggtcattttcccagtttattcattgaattatgtaattggattatttgtgctacacttccttgtctttggattatttaaacatattatttgcgcttctcaaaatatttttctatttt

SEQ ID NO: 529 - DNA, 1654 bp, Sorghum bicolor; identical to SEQ ID NO: 450

SEQ ID NO: 530 - DNA, 1655 bp, Sorghum bicolor; identical to SEQ ID NO: 451

SEQ ID NO: 531 - DNA, 1944 bp, Sorghum bicolor; identical to SEQ ID NO: 449

SEQ ID NO: 532 - DNA, 1648 bp, Sorghum bicolor
ccgggacttcgacccggccggccctatcaaaagcccccttccacaccgcactcccgtgaccttcctccccttcccctcctctgcccccaccgcccgcttccttctgccttgctccgttgcttcctcccaccacagtccactccactcgccggccctgcagctcagtatttgactgagattggtggtggagctgctagcagctcgactcgcttgctacttcttggtcctgacgacggtgcgttcagaccagtgacgacgacgagttgtgaggagagggcaaggaagcaaacctgccagggaggtggcgatggagaggtacgaggtgatcaaggacataggatcgggtaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggaggttgtgctaactcccacacatttggccatagttatggaatatgctgctggcggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatktgattttggttactccaagtcctctgtgttgcactctcaaccaaaatcaactgtcgggacaccagcttacattgctccagaggtccttgctagaaaggaatatgatggaaaggtcgccgatgtttggtcatgtggagttactctgtatgtgatgcttgttggtgcttatccatttgaggaccccgacgaaccgaagaatttccgcaagacgcttactcggattctcagtgtccaatatgcggttcctgattttgtccgagtttcaatggagtgcagacatctgctgtctcggatctttgtggcgatccctgagcaacggataaccatcccagagatcaagaaccacccgtggttcttgaagaacctgcccatcgagatgaccgacgagtaccagatgaacctacagctggttgacatgaatggcccctcgcaaagtctggaggagatcatgaccatcatacaagaggcccggaagcccggtgacgggctgaagcattcgggacagctccctggcctggggagcatggagctggatgacattgatgtcgacgacatagatgttgaggacagcggtgactttgtatgtgccttgtgacgtggttcaagctgtctcggcgctgttgctgtcacgggactctcccccacccttctggtcttgtgttctactgttattccatcttgtttcagcgagctccgagctcccattttgttgttgtaatatcacatgttttgcgtaatcaaggtagtcacgctgtggataaataatagacgttattatgtcatgtattcttgctgaattcttgttcaggtcctgtgtttgccctgtatgaactgggcagtttcatgagtgcctcagcctgatcttttgatctgctgcatgtagccaatgtgttttttattattattattttactag

SEQ ID NO: 533 - DNA, 1479 bp, Sorghum bicolor
aaatcccgaccccgcctccmcycctsswccrgcygacctcccgctcccgctcccgctccgccccattcccaccaccaccaccggggcccagacaggcgcccaatctccaccccacgccgcgccttcgccgtcttcttcctctgctgcggtcggttagcctggccgtggccgcctcctgctcttcttcgatctcgcgctgcgagctgcgatatggagcggtacgaggtgattagggacatcgggtcgggcaacttcggggtggccaagctcgtccgggacgtcaccaccaaggagctcttcgccgtcaagttcatcgagagagggcagaagattgatgaacatgttcagagggagattatgaaccaccggtccctgaagcacccaaacataattagattcaaggaggtcgtgctaactcccacacatttggcaatagttatggaatatgctgctgggggtgaactatttgaaaggatttgtaatgcggggagattcagtgagaatgaggcaaggttcttcttccaacaactgatttcgggagtgagctattgtcattccatgcaagtatgtcatagagacctgaaactagaaaacactctcttagatggtagtgttgcacctcggctcaagatctgcgatttcggttactccaagtcttctgttcttcactctcaaccaaaatcaactgttggcacacctgcatatattgctcccgaggtcctctctagaaaagagtatgatggaaaggttgctgatgtttggtcttgcggagtcacactatatgtgatgcttgtcggcgcatatccttttgaagaccctgatgacccaaagaacttccgcaagacgatcactagaatactcagcgtacagtactcaattccagactatgttcgtgtttcaacggagtgcagacatctgctgtctcggatatttgttggaaatcctgagcagagaataaccattcctgagatcaagaaccacccgtggttcctcaagaacctgcccgtggagatgaccgacgagtaccagcagagcatgcagcagctggcagacatgaacaccccggggcagagcctggaggaggtcatggcgatcatccaggaggcgcagaagccaggggacgccgtgagcctcgccgggcagctgccctcctgcctggggagcatggaccttgatgacattgatttggacgatatcgatgacattgacatcgagaacagcggcgacttcgtttgtgcggtgtgatgctctcatgcgtgcgtgattcaggtagcagagtagcagagagctccctttggtggttggtgtatgtctgtagatccttgttgtgttatgttacttccattcgtttctggatcacgcatgttgtgtaaccgagaaattggcgttcctgtggacaacatacatgatgaacttatatgctgaaatctaccgaaaatcctctgtgatttgctgaatgagcacatcggttcccctgcg

SEQ ID NO: 534 - DNA, 1307 bp, Sorghum bicolor; identical to SEQ ID NO: 66

SEQ ID NO: 535 - DNA, 1511 bp, Sorghum bicolor
cctggctcttctctgctgggagagattccttttgttcggtgtcgccacaactcgccattcttgggaggtctaaggtcgtcgggatcgggaccgctgctgatggaggagaggtacgaggcgctgaaggagcttggggccggcaacttcggggtggcgaggctggtcagggacaagcggaccaaggagctcgtcgccgtcaagtacatcgagaggggcaagaaggtacgtacgtagcagtctcccggcttgggcttctgtctcccgttcatgtggcttgagtttgggggttgctggtgctgcttctaaattcggattggtggggtgttggacggtcgagaaatgggagttttagtttagaaagtggctctgacttgagttctgtgtgtttcttggatactactttcgtgagttgtgtctttctgcgcagattgatgagaatgtgcagagggagatcatcaatcaccagtcgctccggcaccctaacatcgtacggttcaaggaggtttgtttaacacccacacatcttgctattgtcatggaatatgctgctggtggagagctatttgagaaaatcaccacagcagggcgattcagtgaagatgagtccaggtatttctttcagcagttgatatcaggggtcagctactgtcactctatggaaatttgtcaccgtgatcttaaacttgagaataccctccttgatgggagtccaacacctcgcgtgaaaatttgtgactttggttactcaaagtctgctttgctgcattccaaaccaaaatcaacagttggaactccagcatacatagcgccggaggttctttccagaaaagagtatgacggaaaggtagcagacgtttggtcctgtggtgtcacactgtacgtgatgctcgtgggatcatatccatttgaagatcctgaggatccaaggaacttccggaaaacgatcagcagaattcttggcgtgcaatactccatcccggattatgtgagagtgtcttcagagtgcaggcgccttctgtctcaaatattcgttgccgatccttcaaagaggatcacgatcccggagataaagcatcacccgtggttcctgaagaacctgccgagggagatctcggagagggagaaggccaactacaaggactcggatgccgccgagccggcgcaggccgtggacgagatcatgcggattgttcaggaggccaagacccccggtgacatgtccaaggtggtcgactcggcgctgctggccgagatggcagagctggagagcgacgacgaagaggcagacgccgatgacgcctactgatcgctcctgcatgcaactcagcagctgcagacgccgccgagccttacccgtgcgtgggataacggatgttggattcttactctgtatgwtaagtctgtatagcgctgtacatttgmagattgccttgtatggatcaactagcgtgcagtgataacaaataaatataagtgagtaaataaagatgtaccatacgctgttagctgct

SEQ ID NO: 536 - DNA, 1749 bp, Glycine max; identical to SEQ ID NO: 455

SEQ ID NO: 537 - DNA, 1767 bp, Glycine max; identical to SEQ ID NO: 453

SEQ ID NO: 538 - DNA, 1913 bp, Glycine max; identical to SEQ ID NO: 457

SEQ ID NO: 539 - DNA, 1786 bp, Glycine max
tctcgagccgaatcggctcgagtacggctgcgagaagacgacagaagggggaaggtatagtggcagtccaattgtaatttgcaacaagggcatctaaacccagaacccaatcatcttttattgcaaacttttgtgcattggaatttggaggccataaaaaagatgcgatgctacacgcaaacaagtagtacaagtccaataagaaaagcaagatagaaagattggctagttcacacacctcaattaatacaacaacaccctgttgctgatagttattatagagagagttcgatcaattcaagcttgcaagcttaaccatggaacggtatgagataattaaagatattgggtcaggaaactttggtgtggcaaagctggtcaaggaaaaatggagtggtgaattatatgctatcaagttcattgagagaggcttcaagattgatgaacacgtgcaaagagagattataaatcataggtccttgaagcatcccaatatcattagatttaaagagttgttgcttactccaactcatcttgcaatagtcatggaatatgcttccgggggagaactgtttgaaagaatatgcagtgctgggagattcagtgaggacgaggcgagatatttctttcagcaactgatttctggagtcagctattgccattcaatggaaatttgccacagagatcttaagctggaaaacacacttctagatggaagctcagcaccacgacttaaaatctgtgactttggttactcaaagtcatctgttttgcactcccagccaaaatcaacggtaggaacccctgcctatattgcaccagaggttttgtcaagaagagaatatgatgggaaggtcgcggatgtttggtcttgtggggtgaccttatatgtgatgttggttggagcatatccttttgaagacccagaagacccaagaaacttcagaaaaacacttcagcgaattcttagtgtccactattcaattccagactatgtacgaatcagtaaagagtgtaggcaccttttgtctagaatatttgtggccaacccggaaaagagaattaccataccagagattaaaatgcacccttggttcctaaagaatttgccactagaatttatggacgagagtgaaggggtgttgcaaaatgatgatcatgtgaatgaagactcatctgaaatcactcaaagcattgaagaaatactggccataattcaagaggctaggaaaccgagtgagggcccaaaagttagtgagcaatttgttgggggcagcatggacctcgatgatattgatgcggatgctgacatcgatgacattgagacaagcggtgattttgtctgtgcattgtgaatgaatattgatgatgcttgcaatcttgcactttgcatactatttctccctgaaaagcgtttaagataagagggtacttaacgagatagatgttaggaagtttggtatcaattagtttcaattgattttaagttgaaatctaacatggtattaaaatctatagtccatcttaatttcttattttagtaggttgtttgtattgattttagattgaaatctaacaatagatagatagggtagaatcaaacaaaatctggctatcatggtttttgatttttcttttattagaagttagcttgtcttgttatctgccaatgccaatgtgggaataagggaatgttactggtttcttggttggtttaatgcttagccaaaaaatcaagccagactgcatgcatatgtaataattaataatatagtagtttgggtct

SEQ ID NO: 540 - DNA, 1775 bp, Glycine max
aattcggcaccagaaagtcctgtgtctgaaggtatagtggcagtccaattgtaatttgcaacaagggcatctaaacccagaacccaatcatcttttattgcaaacttttgtgcattggaatttggaggccataaaaaagatgcgatgctacacgcaaacaagtagtacaagtccaataagaaaagcaagatagaaagattggctagttcacacacctcaattaatacaacaacaccctgttgctgatagttattatagagagagttcgatcaattcaagcttgcaagcttaaccatggaacggtatgagataattaaagatattgggtcaggaaactttggtgtggcaaagctggtcaaggaaaaatggagtggtgaattatatgctatcaagttcattgagagaggcttcaagattgatgaacacgtgcaaagagagattataaatcataggtccttgaagcatcccaatatcattagatttaaagagttgttgcttactccaactcatcttgcaatagtcatggaatatgcttccgggggagaactgtttgaaagaatatgcagtgctgggagattcagtgaggacgaggcgagatatttctttcagcaactgatttctggagtcagctattgccattcaatggaaatttgccacagagatcttaagctggaaaacacacttctagatggaagctcagcaccacgacttaaaatctgtgactttggttactcaaagtcatctgttttgcactcccagccaaaatcaacggtaggaacccctgcctatattgcaccagaggttttgtcaagaagagaatatgatgggaaggtcgcggatgtttggtcttgtggggtgaccttatatgtgatgttggttggagcatatccttttgaagacccagaagacccaagaaacttcagaaaaacacttcagcgaattcttagtgtccactattcaattccagactatgtacgaatcagtaaagagtgtaggcaccttttgtctagaatatttgtggccaacccggaaaagagaattaccataccagagattaaaatgcacccttggttcctaaagaatttgccactagaatttatggacgagggcgaaggggtgttgcagaatgatgatcatgtgaatgaagagtcatctgaaatcactcaaagcattgaagaaatactggccatagttcaagaggctaggaaaccgggtgagggcccaaaagttggtgagcaatttgttgggggcagcatggacctcgatgatattgatgcggatgctgacatcgatgacattgagacaagcggtgattttgtctgtgcattgtgaatgaatattgatgatgcttgcaatcttgcactttgcatactatttctccctgaaaagcgtttaagataagagggtacttaacgagatagatgttaggaagtttggtatcaattagtttcaattgattttaagttgaaatctaacatggtattaaaatctatagtccatcttaatttcttattttagtaggttgtttgtattgattttagattgaaatctaacaatagatagatagggtagaatcaaacaaaatctggctatcatggtttttgatttttcttttattagaagttagcttgtcttgttatctgccaatgccaatgtgggaataagggaatgttactgctttcttcgtttttttaatgcttagccaaaaaatcaagactgyatgcatatgtaatrattaataatatagtagtttggstytctttcttcccttttca

SEQ ID NO: 541 - DNA, 1797 bp, Glycine max
cgtacgggctcggaatcacgtgactcgagcgtatcggctcaggcaattgaaccaactgattaccgtttccgttttgagtactactaccaatggtgatcttgttcacgggaaagatctcgccatggttaaagtcaatgtagcatctgctgctgctggcttgacatcaagctatcctccgactccatcgttggaatctggtttgcaaamagacagagggttaattgtggagtattttggaaggatgtcttacgttgctcataacgttaatcagccccaagagaaagatttrttsrarggraawwtttccytmtawyaaatctyctcttttgattttgataccccttattattatttatttccataccctctcttcacttcttcctcaccaattttctgaacactgacactcttctctccttaaagccaccacattctgatacccttttgatcaatcaaagtgaagatcagcatagaatgcttgtttgattctatttcattgctatggataagtacgaggctgttaaggatttgggagctggcaattttggggtggctaggctcatgaggaacaaggtcaccaaggagcttgtagccatgaaatacatcgagcgtggccccaagattgatgagaacgtggcaagggagattatgaaccacaggtcccttcggcatcccaatataattcgttacaaggaggtggttttgactcccacacatttagcaatagtgatggagtatgcagcaggaggagagctctttgagaggatatgcagtgctggcaggttcagtgaagatgaggctagatatttctttcagcagctgatttccggtgttcatttctgtcataccatgcaaatatgccacagagatttgaagctagaaaatacccttctagatggaagtcctgcacctcggttgaaaatttgtgacttcggttattccaagtcatctttgctgcactcacgacccaaatcaacagttggaacaccagcttacatagcaccggaagttctttctaggcgagagtatgacggaaagttggctgatgtatggtcatgtgcggtgactctttatgtcatgctggttggagcatatccctttgaggaccaggatgaccctaggaattttaggaaaacaattcagcgtataatggctgttcaatacaaaatccctgattatgttcacatatctcaagattgtaggcacctcctctctcgtatatttgttgcaaatccattgaggagaattactattaaggaaattaagaatcacccatggtttttgaggaatcttccaagggagctaactgaatctgctcaagctatctattaccagagagacagcccaaactttcaccttcaaagtgtggatgagataatgaaaattgtaggagaggcaagaaatccacctccagtatctaggcctgtcaaaggttttggctgggaaggtgaagaagatttggatgaagaagtggaggaagaagaggatgaagatgagtatgataagagggtcaaagaggttcatgcaagtggcgaatttcaaattagttaaagccctcaaattcttgtgtactttgttgaaatattgtactttttagaagtcacccttttttgtgtacacgaagtcacctatttatgtgcattataattatggctctgttgttgtaatatagtaccgggtatcatcaaaatggttgctatgtatgagaatagtagttgtctaattacgttctaaatcgacatgagaaccatagttgtctgattacatgctaaaatctaaattaccttttcctgtttt

SEQ ID NO: 542 - DNA, 1217 bp, Glycine max
ccaaaacaaaaccatatccgtttccttattttggtcttctcttgtatacagttttggtctgtaattttattgcttttggtgagagtggatatggaggaacggtacgagactttaaaggagcttggttcagggaacttcggagtggcaaggttggccaaagacaaggagacaggagaacttgttgctatcaaatacatagaaaggggaaaaaagattgatgcaaatgttcaacgggagatagttaatcatcgatctttaaggcatccaaatattatcaggttcaaagaggtatttctgacccctactcatttagctatcgtcctagagtatgctgctggtggcgaactcttcgagaggatatgcaatgctggtcgattgagtgaagatgaagcaagatgtttctttcaacaactaatatctggagttagctattgtcattccatgcaaatatgtcatagagatctgaaattggaaaacactctactagacggaaatccagctcctagacttaaaatttgtgactttggtttctccaagtctgctttgctgcactctcaacctaaatcaactgttggaacacctgcatacattgctccagaagttttgtcacgaaaggaatatgatggaaaggttgccgatgtttggtcgtgtggtgtgactctttatgtcatgttagttggagcatacccatttgaagatccagaagatcctaaaaatttcagaaagagtattgggagaattatgagtgttcaatacgccatacccgactacgtgcgtgtctctaaggagtgtaggcatcttatctcttgtatttttgttgccaatcctgccaagaggatcagcatctcggagataaaacagcacctttggtttaggaagaacctgccaagggagataattgagcctgaaagaaggggttacgaggaaacacaaaaggacccaaccaagccaaagtgtggaagaaaccatgcggatcatacaagaagcaaggacaaaaatccacactggtgagcaagctggtacaggaacctcggatgctgtgcatggtgatgaggctaatgaggaagttgatattaatgaccactatgccaaatacctagcccttaattagtttgtggttgggtgtttaccaaagctagtgtgcattcttcgtgtgtaaggtatagagttgaatgagacataacacttcatcgaatttgagagttgtatcaattttt

SEQ ID NO: 543 - DNA, 1416 bp, Glycine max
agagtttaaaatggtgttgtgattctacgagggtcttgcatgcccctttaagtttcaagtttcaagtttgagccccctttctgtaatccataaccatagctttggttgagttgagggatttgattatggataagtatgaggctgtcaaggatttgggagctgggaattttggggtggctaggctcatgaggaacaaggagaccaaggagcttgttgccatgaaatacatcgagcgtggccaaaagattgatgagaatgtggcaagagagattatcaaccacagatcccttcggcaccccaatataattcgcttcaaggaggtggttttgacccccacccatttggccatagtgatggagtatgcggctggaggagagctctttgagaggatatgcaatgctggcaggttcagtgaagatgaggctagatatttctttcagcagctgatttctggtgtacattactgtcatgccatgcaaatatgtcacagagatttgaagctagaaaatacccttttagatggaagccctgcaccccgcctgaaaatttgtgactttggttattccaagtcatcattacttcattcacgaccaaaatcaactgttggaactccagcttatatagcaccagaggttctttccaggagggagtatgatggcaagttggctgatgtatggtcatgtggagtgactctttatgtcatgctggttggagcttatccctttgaggatcaggatgaccctaggaattttaggaaaacaattcagcgtataatggctgttcaatacaaaatccctgattatgttcacatatctcaagactgcagacacctcctttctcgtatatttgtagcaaatccattaaggaggatctctcttaaggaaattaagagccacccatggtttttaaagaatcttccaagagagctgactgaatcagctcaagctgtctattaccagagaggcaatccaagcttttcaattcaaagtgtggaggagatcatgaagattgtgggagaggcaagggaccctcctccagtatctagacctgtcaaaggttttggctgggatggcgaagaagatgaaggggaagaagacgtggaggaagaggaggacgaagaagacgagtatgacaagagggtcaaagaggttcatgcaagtggagaatttcaaatcagttaagcactataataattcttgtgtacttggttaaagtattttttttaatgctagaagtcatctatttatgtgtactataatttataataactactactataaaccatcgaggcagcctaacttatggcactgtccatgtaatgtgttagtattttttacctgtatcatcatcgaagccgtgtatgagaacagtagttatctgataacttcaaaattactcatgcctgttataacctcc

SEQ ID NO: 544 - DNA, 2157 bp, Glycine max
ccacgcgtccgcacaaactcaaatacggcttcgagaagacgtcagaagggggagaaagaaaatgaaagtaactgaaaaaatagtgttcatttactgtcccctgtagcaacggagtaatacgtagacccattcgaaattcttcataacacaccataatattaactcttacaaaattcaaataaaccaacaaaaaactcacatattaattttctctaaacatttttctatggacaaactcaaccctmaaaawccaaaasggcastyactaattttcacaactggattcaagctgttytctcttcctcttcttcatgttcattkattgaatcccaccccaawtttctaatkctttytctytcmcwctcccacgtgcacyttcctcttcyccgctctaaataattctccrttctcwttctctctctctctctcycaatacawtattatatatgtgtgtggaaaaaagaaccgtttttttttcagygaaagcgaccacctttatattacccttttgatcagagtttaaaatggtgttgtgattctacgagggtcttgcatgcccctttgagtttcagttttcaagtcttgcatgcccctttaagtttcaagtttcaagtttgagccccctttctgtaatccataaccatagctttggttgagttgagggatttgattatggataagtatgaggctgtcaaggatttgggagctgggaattttggggtggctaggctcatgaggaacaaggagaccaaggagcttgttgccatgaaatacatcgagcgtggccaaaagattgatgagaatgtggcaagagagattatcaaccacagatcccttcggcaccccaatataattcgcttcaaggaggtggttttgacccccacccatttggccatagtgatggagtatgcggctggaggagagctctttgagaggatatgcaatgctggcaggttcagtgaagatgaggctagatatttctttcagcagctgatttctggtgtacattactgtcatgccatgcaaatatgtcacagagatttgaagctagaaaatacccttttagatggaagccctgcaccccgcctgaaaatttgtgactttggttattccaagtcatcattacttcattcacgaccaaaatcaactgttggaactccagcttatatagcaccagaggttctttccaggagggagtatgatggcaagttggctgatgtatggtcatgtggagtgactctttatgtcatgctggttggagcttatccctttgaggatcaggatgaccctaggaattttaggaaaacaattcagcgtataatggctgttcaatacaaaatccctgattatgttcacatatctcaagactgcagacacctcctttctcgtatatttgtagcaaatccattaaggaggatctctcttaaggaaattaagagccacccatggtttttaaagaatcttccaagagagctgactgaatcagctcaagctgtctattaccagagaggcaatccaagcttttcaattcaaagtgtggaggagatcatgaagattgtgggagaggcaagggaccctcctccagtatctagacctgtcaaaggttttggctgggatggcgaagaagatgaaggggaagaagacgtggaggaagaggaggacgaagaagacgagtatgacaagagggtcaaagaggttcatgcaagtggagaatttcaaatcagttaagcactataataattcttgtgtacttggttaaagtattttttttaatgctagaagtcatctatttatgtgtactataatttataataactactactataaaccatcgaggcagcctaacttatggcactgtccatgtaatgtgttagtattttttacctgtatcatcatcgaagccgtgtatgagaacagtagttatctgataacttcaaaattactcatgcctgttataacccgcatagttaaagcttaaaatgctttttaatagtaatatagtagatgaaagaatggtctcagtcatgtcttgtgccgggtatcatcaaaatggttgctatgtatgagaatagtagttgtctaattacgttctaaatcgacatgagaaccatagttgtctgattacatgctaaaatctaaattaccttttcctgtttt

SEQ ID NO: 545 - DNA, 1717 bp, Glycine max
tttacgtgacacgaaattgagtgtttccattatgaaaaagaattaatggcacttgatcatatgttgtgtgaaaattagttgtaaccataatagtccttgatcatgtaataatttcttgtatttaagtaggtttgtttcttgtaccctgagaatccccttgtgtttttcaacttactatttctcatatccgtttccttatttttttctttctcttgtatacagttttggtctgtgatttgtttgctttggtgagagaattggacatggaacctctttgagaggttggtgtagtagctttttggagggttgacatggaagaacggtatgagccattgaaggagcttggtgctgggaattttggtgtggcaaggttggcaaaagacaagaaaactggagagcttgttgcggtcaaatacatagagaggggcaaaaagattgatgagaatgttcagagggagataattaaccaccgatctttaaggcatccaaatataatcaggtttaaagaggtgttactgacccctacacatttagctatcgtcttggagtatgcttcaggtggtgaactttttgagaggatttgtactgctggtcgatttagcgaagatgaggcaagatatttcttccagcagctaatatctggggttagctactgtcattcaatggaaatttgtcatagagatctaaaattggaaaacactctcttggatggaaatccatctcctcggcttaaaatttgtgactttggttattccaagtctgctctactgcactctcaacctaaatcaacagttggaactcctgcatacattgctccagaggttctgtcacgaaaggagtatgatggaaagatttcagatgtttggtcctgtggagtgactctttatgtcatgttagttggtgcatacccatttgaagatccagaagatcctagaaatttcagaaagactattgggagaataataggtgttcagtactccatacccgactatgttcgtgtttcttctgactgtaggaatcttctctctcgcatctttgttgctgatcctgccaagaggatcaacatctcggagataaaacagtatctttggtttatgaagaatatgccaaaagagataattgaggctgaaagaaaaggtttcgaggaaacaaaaaaggaccaaccaagccaaaatgtggaagaaatcatgcagatcattcaagaagcaaggataccaggacaaggatccaaagctggagaaggtggacaagctggcacaggaacttcggatgttgtgctggtaggctaatgaggaagttgatattaatgaccactttgccaaatgacctaacccttgattaatttgtgtggctaaattccctctctctctatatatatattgtttaccgaagctagtgtgcattcttcgtgtgtatgatatagagttgaatgagacacaacacttcatcgaatttgaaagttgggctattttgtttatcaattataagaattaatttttgttgtttattaaaatgaagaagattaaaaaaacgctgttactatagatatattggctaccgaagctagtgtgcattcttcgtgtgtttgatatagagttgaatgagactcaacacttcatcgaatttgaatgttgggctatgttgcttatcaattataagaagaagtaagttctatcaattacagaaagagtcggactttctgggttgggtaagtttg

SEQ ID NO: 546 - DNA, 1334 bp, Glycine max; identical to SEQ ID NO: 67
  misc_feature (1274)..(1275): n is a, c, g, or t
  misc_feature (1278)..(1280): n is a, c, g, or t
  misc_feature (1325)..(1326): n is a, c, g, or t

SEQ ID NO: 547 - DNA, 1322 bp, Glycine max
  misc_feature (1262)..(1263): n is a, c, g, or t
  misc_feature (1266)..(1268): n is a, c, g, or t
  misc_feature (1313)..(1314): n is a, c, g, or t
cttaactccttgagaggttggtgtagtagctttttggagggttgacatggaagaacggtatgagccattgaaggagcttggtgctgggaattttggtgtggcaaggttggcaaaagacaagaaaactggagagcttgttgcggtcaaatacatagagaggggcaaaaagattgatgagaatgttcagagggagataattaaccaccgatctttaaggcatccaaatataatcaggtttaaagaggtgttactgacccctacacatttagctattgtcttggagtatgcttcaggtggtgaactttttgagaggatatgtactgctggtcgatttagcgaagatgaggcaagatatttcttccagcagctaatatctggggttagctactgtcattcaatggaaatttgtcatagagatctaaaattggaaaacactctcttggacggaaatccatctccccggcttaaaatttgtgactttggttattccaagtctgctttactgcactctcaacctaaatcaacagttggaactcctgcatacattgctccggaggttctgtcgcgaaaggagtatgatggaaagatttcagatgtttggtcctgtggagtgactctttatgtcatgttagttggtgcatacccatttgaagatccagaagatcctagaaatttcagaaagactattgggagaataatcggtgttcagtactccatacccgactatgttcgtgtttcttctgactgtaggaatcttctctctcgcatctttgttgctgatcctgccaagaggatcaccatcccagagataaaacagtatccttggtttctgaagaatatgcctaaagagatcatcgaagctgaaagaaaaggattcgaggaaacaaccaaagaccaaccaaaccagaaggtggaggaaatcatgaggataattcaagcggcaaggataccaggacaaggatccaaagctggagaaggtggacaagctggcactggatcattagatattgaggatgatgaggaaattgatgttagtggtgactatgaacaagtgtgatcgagaacttgattagttgatatggctagattgtctataagacatagtcagcattattaacatctatcacagtgtgcaacactggtgttctaaagatacttgttataccaggcttgaaataggattttgtgtttatttaaatgaataatattaagaaaaggctgctatttcagtttcagtaaatcattggtgttgttcctagtcnnctnnntattccaaattttaatactttgtataaaaagaagtatttgatatnntcacacaa

SEQ ID NO: 548 - DNA, 1838 bp, Glycine max
ggtaagtatattaagatatacaaaactaaaaattgcatacaccacagtcgttagggagtgtcttcaaggagaaattacaaatagtcttagactagtcgtgtttacggtctcgatcaatttttacgtgacacgaaattgagtgtttcmattatgaaaaagaattaatgrcacttgatcatatgttgtgtgaaaattagttgtaaccataatagtccttgatcatgtaataatttcttgtatttaagtaggtttgtttcttgtacmctgagaatccccttgtgttttccaaaacaaaaccatatccgtttccttattttgktcttctcttgtatacagttttggtctgtgatttgttgctttggtgagagagtggatatggaaactctttgagaggttggtgtagtagctttttggagggttgacatggaagaacggtatgagccattgaaggagcttggtgctgggaattttggtgtggcaaggttggcaaaagacaagaaaactggagagcttgttgcggtcaaatacatagagaggggcaaaaagattgatgagaatgttcagagggagataattaaccaccgatctttaaggcatccaaatataatcaggttcaaagaggtgttactgacccctacacatttagctattgtcttggagtatgcttcaggtggtgaactttttgagaggatttgtactgctggtcgatttagcgaagatgaggcaagatatttcttccagcagctaatatctggggttagctactgtcattcaatggaaatttgtcatagagatctaaaattggaaaacactctcttggatggaaatccatctcctcggcttaaaatttgtgactttggtttctccaagtctgctttactgcactctcaacctaaatcaacagttggaactcctgcatacattgctccagaagttttgtcacgaaaggaatatgatggaaaggtttcagatgtttggtcctgtggtgtgactctttatgtcatgttagttggagcatacccatttgaagatccagaagatcctagaaatttcagaaagactattgggagaataataggtgttcagtactccatacccgactatgttcgtgtttcttctgactgtaggaatcttctctctcgcatctttgttgctgatcctgccaagaggatcagcatctcggagataaaacagtatccttggtttctgaagaatatgcctaaagagatcatcgaagctgaaagaaaaggattcgaggaaacaaccaaagaccaaccaaaccagaaggtggaggaaatcatgaggataattcaagcggcaaggataccaggacaaggatccaaagctggagaaggtggacaagctggcacaggaacttcggatgctgtgcatggtgatgaggctaatgaggaagttgatattaatgaccactatgccaaatacctaacccttgattaatttgtggttggctaaattccctctctctctatatatatattgtttaccgaagctagtgtgcattcttcgtgtgtatgatatagagttgaatgagacacaacacttcatcgaatttgaaagttgggctattttgtttatcaattataataagaattaatttttgttgtttawtaaamtgaaraasattwaaraaacgctgttactatagatatattggctaccgaagctagtgtgcattcttcgtgtgtttgatatagagttgaatgagactcaacacttcatcgaatttgaatgttgggctatgttgcttatcaattataagaagaagtaagttctatcaattacagaaagagtcggactttctgggttgggtaagtttg

SEQ ID NO: 549 - DNA, 1570 bp, Saccharum officinarum; identical to SEQ ID NO: 459
  misc_feature (6)..(6): n is a, c, g, or t

SEQ ID NO: 550 - DNA, 1767 bp, Saccharum officinarum
ccctcctctgcccccaccgcccgcttscttctgccttgcyccrttgcttcytcccaccacagtccactccactcgccggccctgcagctctgctcagtatttgactgattggtggtggagccgctagcagctcgactcgcctgctacttcttggtcctgacggtgcgttcagaccagtgccgactacgagctgtgaggagagggctaggaagcaagcctgccagggaggtggcgatggagaggtacgaggtgatcaaggacataggatcgggcaactttggggtggccaagctggtccgggacgtcaggaccaaggagctcttcgccgtcaagttcatcgagcgggggatgaagatagatgagaatgtccaaagagagatcatgaaccacaggtcgctgaggcatccaaacatagttaaatttaaggaggttgtgctaactcccacacatttggccatagttatggaatatgctgctggtggtgagctatttgaaaggatctgcaaagctggaagatttagtgaggatgaggcaagattcttcttccaacaactgatttcaggagttagctattgtcattcaatggtatatagttatctccaactaacatgtgattagtaacttaaagcagaacatctgtgacataatgctatttttgtttccttgctgcagcaaatatgtcatagagatttgaaactagaaaacactctcctggatggtagtatagcacctcggctaaagatatgtgattttggttactccaaggtattgcagattataaactttagtaagcagcttgccgacaaatgaacactatataaatcatactcagatttttttcccagtcctctctcctctgtgttgcactctcaaccaaaatcaactgtcgggacaccggcatacattgctccagaggtccttgctagaaaggagtatgatggaaaggtgattcctgtcttcgctagttcttgtttcctatgtggtcttatttccagtggagtggcgcacaaacttgctgcatcttccgaataagagaaatatcctaattaataaaaccgagccctcaaacatcaccatgtgcaatttaggttgccgatgtttggtcatgtggagttactctgtatgtgatgcttgttggtgcttatccctttgaggaccccgacgaaccgaagaatttccgcaagacgcttactcggattctcagcgtccaatacgcggttcctgattttgtccgaatttcaatggagtgcagacatctgctgtctcggatctttgtggcgaaccctgagcaacggataaccatcccagagatcaagaaccacccgtggttcttgaagaacctgcccatcgagatgaccgatgagtaccagaggaacctacagccggtggacatgaatgccccctcgcaaagtctggacgagatcatggccatcatacaggaggcccggaagcccggcgaygggctgaagcattcaggacagctccccggcctggggagcatggagctggatgacattgatgtcgatgacatagacgttgaggacagcggtgactttgtatgtgccttgtgacgtggttcaggctgccggcgccgttgctgctgtggactctcccccacccttctggtcttgtcttgtgttctgctgttattccatcttgtttgtttcagcgagctccgagctcccattttgttgttgtaatatcacatcttttgtgtaatcaaggtagtgacgctgtggataaataatagacgttatgtgctgcatt

SEQ ID NO: 551 - DNA, 1654 bp, Saccharum officinarum
cgaacgagcaagaggccacctcctcaagcttcgaatcctccccttccgcggtttcttccctccccctcctctcatcccctttccagtcccccaccccagcgaagcttccaaacccgccccgacctcggagggagccatggagaagtacgagctgctcaaggacatcggctccggcaacttcggggtggcgcgcctcatgcgcaacaaggacaccaaggagctcgtcgccatgaagtacatccccagggggctcaagattgacgagaatgtggcgagggagatcatcaaccaccgctcgctgcggcaccccaacatcatccgcttcaaggaggtcgtgctcacgcccacgcacctcgccatcgtcatggagtacgccgccggcggcgagctcttcgaccggatctgcaacgccgggaggttcagcgaggacgaggcgaggtatttcttccagcagctcatctgcggtgtcagctactgccacttcatggtgagaacaccaaccaacaaaaaaggtacccagggaaaaaaaaatccatgctgatgaggtgtgcgactgcaaattttgtttcgattcattcacagcaaatttgtcaccgggacttgaagctggagaacacgctgttggatggcagcccggcgccgcgcctaaagatctgcgactttggctactccaagtcatcgctgctgcactcaaagcctaaatccacggttggaactccggcctacattgctccggaggtgctctctcgccgggaatacgacggcaagatggcagacgtttggtcttgtggagtsacyctwtaygtgatgctggttggtgsgtacccttttgaggaccccgatgatcccaagaatttcagaaaaacgatcgggagaatagtgtcaattcagtaccagataccagagtatgtccacatatcccaagactgcagacagctccttgctaggatcttcgtcgcaaatcctgcaaagktactgttggsmagtgaatcctgcaaagcytcaatccwtttaywatggttaccatcttaatgccatatcgtctcatttcgtcagagaataacaattagggagattaggaatcacccctggttcctgaagaatttgcccagagagcttacagaagctgcgcaagcgaagtactacaagaaggacaacagtgcccccaccttctctgatcaaaccgtcgaagagatcatgaagatcgtagaggaggcccgcacgccgccccaatcatttactccggtggctggttttggttgggctgaggaagaagagcaggaagatggcaagaaacttgaggatgacgagcaggatggggaggatgaggaatacgattgcgaggacgagtatgacaaacaggtgaagcaagtacatgccagcggggattttcgacacctgataaagtgaagctcctggcaaggccaagttctcaactgatgagatactgtttggatttgttgtagtttgtggtgctgagatgctgcaccctcggtgcttacttgtagtttccttctgtctggatccaccttttttcgcatattgtgttatactctgtaaattatcaaactggcttcctcaatgcctgtgtaattgcaatgaaccgttgagtgattaagctagaaggcgaaatataatttctatggaatatccc

SEQ ID NO: 552 - DNA, 1521 bp, Saccharum officinarum
cgtgtgaccggtcgaccacgcgtccgcttttcttcggtgtcgccaactcgccattcttgggagttctaggtcgggaccgctgctgagtgctgaactgctgatggaggagaggtacgaggcgctaaaggagctgggggccggcaacttcggggtggcgaggctggtcagggacaagcggaccaaggagctcgtcgccgtcaagtacatcgagaggggcaagaagatcgatgagaatgtgcagagggagatcatcaatcaccagtcgctccggcaccctaacatcgtacggttcaaggaggtttgtttaacacccacacatcttgctatcgtcatggaatatgctgctggtggagagctatttgagaaaatcaccacagcagggcgattcagtgaagatgagtccaggtatttctttcagcagctgatatcaggagtcagctactgtcactctgtggtatggttttgcttcgagaagttgacaagttcaagaatagtggagtgtaagttttaatgagctgcaaatgcaggaaatttgtcaccgtgatcttaaacttgagaataccctccttgatgggagtccaacacctcgcgtgaaaatttgtgactttggttactcaaaggtgctgtatatggatactgcgcctgttatgcatcctaactttaccagmaactgacttctctkgkgtcgttgaawyagttacaaactttgctartgtgcttttmagtctggtttgctgcattccaaaccaaaatcaacagttggaactccagcatacatagcgcccgaggttctttccagaaaagagtatgatggaaaggtagcagacgtttggtcctgtggtgtcacactgtacgtgatgctcgtgggatcgtatccatttgaagatcctgaggatccaaggaacttccggaaaacgatcagtagaattcttggcgtgcaatactccatcccggattatgtgagagtgtcttcagactgcagacgccttctgtctcaaatattcgttgccgatccttcaaagaggatcacgatcccggagataaagcatcacccgtggttcctgaagaacctgccgagggagatctcggagagggagaaggccaactacaaggacgcggatgccgccgagccggcgcaggccgtggacgagatcatgcggatcgttcaggaggccaagacccccggtgacatgtccaaggtggtcgacccggcgctgctggccgagatagcagagctggagagcgacgacgaagaggcagacgctgatgacacctactgatcgctcctgcaggcagctcagcagctgctcactcatggcgtcgagtcctttgtgctgcagatatggcgccgccgagcctaacccgtgcgtgtgataagggatgttgcattccactctgtataataagtttgtatagcgctgtacaattgcagattgccttgtacggatcaactagcatgcagtgacaatacataaatataagtgagtaaataaagatgtaccatacgctgtttagctgctc

SEQ ID NO: 553 - DNA, 2030 bp, Nicotiana sp.
ggcacgaggagctttcaattttaataatatattcttcattcttccttcttcattcttcattccctttctctctttcttactattatttcacacttctatgcacttctgtccctgttattccctagaatctctctctctgtctcgtgcacaaaaaatcacacacacacacacacacacactattggattccttgctttagcttcaaatttctgctaattaatcttttgctttcttttttctccacctcaatttcggtttcgtcttcttccctcagtttcctaatcttttttggtctcaagaaaccctaattcttcttaaattcacggattttcaaataccatattgtaattcagcttaaaggtgttggatttaggctgtttctggagttggaattttgggaaaatctgggaattttataaatttctttaaaaattgatccttttttgtgttaaatttaaaaccttaattttcaaatttggtatctgtcatcagaatttggctttgtttggtgttagaaagggtttgctggatttctggttttaagttaagggattttgtacttattttaatatatagtgaagtttgtgaaggataagaaaatggataaatacgagcttgtgaaagatatagggtcagggaattttggtgtggcaaggctgatgaggcacaaggaaaccaaagaacttgtggcaatgaaatacattgagagaggacataagattgatgagaatgtagcaagggagatcattaatcatagatcgcttcggcatccaaacataattcgattcaaggaggtgttagtgactcccactcatcttgccattgttatggaatatgcagctggtggagaactgtttgagcgcatttgcaatgcaggaaggtttagtgaagatgaggctaggtactttttccagcagcttatttcaggagttcactactgtcacaacatgcaaatatgccatagagatttgaagctggagaatacgcttcttgatggaagtccagctccacgcttgaagatatgtgattttggatactcaaagtcgtccctgttgcattcgaggccaaaatcaactgttgggactccagcttatattgctcctgaggtcctatcaagaagagaatatgatggcaagctggctgatgtttggtcatgcggggtgacactttatgtgatgctggttggggcatatccttttgaagatcaggaggatccgaagaattttaggaaaactattcaacgaataatggcggtacagtacaagattcccgactatgttcacatatcacaagattgtaggcaccttctctctcggatatttgttgctaatccagcaaggaggatcacaatcaaagaaatcaagtctcacccatggtttttgaagaatttgccgagggaattaacagaagcagcacaggcagcttattacagaagagaaaacccaacattttcacttcagagtgttgaggagatcatgaaaattgtggaagaggcaaagactcccgctccagcttcccgttcagtctcaggctttggctggggaggagaagaagaagaagaggagaaggaaggagatgtagaagaagaggaagaggatgaagaagaagaagacgaatatgaaaagcaagtgaagcaggcacatgaaagcggagaagttcgtctcacctaagtgcacattatcatcttttctcataaagaactgtggacaaacccctagtcctaaattatctttctttggcttgtgaaagactagcttttagcatttcatggttgtgtagaagttgtttcacctaggccttacattatctttttttgcttgtggaaagttacactttctttttaagtgtggggcatttcgtggttgtgtaaaatttatctttcttgttgtttggaattcaaaaagtctgtaaaattttcagagttttttggtaaggatgcttgtgaattatgttaccatgagacaaaggaaatggtgccctgaaaaaaaaaaaaaaaaaaaaaaaaaaaaaaaaaaaaaaaaaaaaaaaaa

SEQ ID NO: 554 - DNA, 1981 bp, Nicotiana sp.
ggcacgaggagctttcaattttaataatatattcttcattcttccttcttcattcttcattccctttctctctttcttactattatttcacacttctatgcacttctgtccctgttattccctagaatctctctctctgtctcgtgcacaaaaaatcacacacacacacacacacacactattggattccttgctttagcttcaaatttctgctaattaatcttttgctttcttttttctccacctcaatttcggtttcgtcttcttccctcagtttcctaatcttttttggtctcaagaaaccctaattcttcttaaattcacggattttcaaataccatattgtaattcagcttaaaggtgttggatttaggctgtttctggagttggaattttgggaaaatctgggaattttataaatttctttaaaaattgatccttttttgtgttaaatttaaaaccttaattttcaaatttggtatctgtcatcagaatttggctttgtttggtgttagaaagggtttgctggatttctggttttaagttaagggattttgtacttattttaatatatagtgaagtttgtgaaggataagaaaatggataaatacgagcttgtgaaagatatagggtcagggaattttggtgtggcaaggctgatgaggcacaaggaaaccaaagaacttgtggcaatgaaatacattgagagaggacataagattgatgagaatgtagcaagggagatcattaatcatagatcgcttcggcatccaaacataattcgattcaaggaggtgttagtgactcccactcatcttgccattgttatggaatatgcagctggtggagaactgtttgagcgcatttgcaatgcaggaaggtttagtgaagatgaggctaggtactttttccagcagcttatttcaggagttcactactgtcacaacatgcaaatatgccatagagatttgaagctggagaatacgcttcttgatggaagtccagctccacgcttgaagatatgtgattttggatactcaaagtcgtccctgttgcattcgaggccaaaatcaactgttgggactccagcttatattgctcctgaggtcctatcaagaagagaatatgatggcaagctggctgatgtttggtcatgcggggtgacactttatgtgatgctggttggggcatatccttttgaagatcaggaggatccgaagaattttaggaaaactattcaacgaataatggcggtacagtacaagattcccgactatgttcacatatcacaagattgtaggcaccttctctctcggatatttgttgctaatccagcaaggaggatcacaatcaaagaaatcaagtctcacccatggtttttgaagaatttgccgagggaattaacagaagcagcacaggcagcttattacagaagagaaaacccaacattttcacttcagagtgttgaggagatcatgaaaattgtggaagaggcaaagactcccgctccagcttcccgttcagtctcaggctttggctggggaggagaagaagaagaagaggagaaggaaggagatgtagaagaagaggaagaggatgaagaagaagaagacgaatatgaaaagcaagtgaagcaggcacatgaaagcggagaagttcgtctcacctaagtgcacattatcatcttttctcataaagaactgtggacaaacccctagtcctaaattatctttctttggcttgtgaaagactagcttttagcatttcatggttgtgtagaagttgtttcacctaggccttacattatctttttttgcttgtggaaagttacactttctttttaagtgtggggcatttcgtggttgtgtaaaatttatctttcttgttgtttggaattcaaaaagtctgtaaaattttcagagttttttggtaaggatgcttgtgaattatgttaccatgagacaaaggaaatggtgccctg

SEQ ID NO: 555 - DNA, 1303 bp, Nicotiana sp.
ggaaaaaaggtagagtctttttgtctttcttgatttgggtatagaatggaggaaaaatatgagcttttgaaagaacttggtgctggtaattttggagtggcaaggctagttaaggacaagaagacaaaggagctttttgctgtcaaatatatagaaagagggaagaagattgatgaaaatgtgcagagagaaattataaatcatagatcgttgggacatccaaacattatcaggtttaaagaggtcttggtaactccatcgcatttagcaattgttatggagtatgcagcaggtggagaactttttgctagaatttgcagtgctggcagatttagtgaggatgaggctcgtttcttcttccaacagctaatatccggagtcagctactgtcatgccatggaaattagctgttgggatttgaaactagaaaacactcttcttgatggaagtgcttcaccacgtgtaaaaatatgtgattttggttattccaagtctggattgttgcattcccaaccaaagtcgacagtaggaacacccgcttatattgcccctgaggtcctgtcacgaaaggaatatgacgggaagatagcagatgtgtggtcatgtggggtgacactgtatgtgatgctagtcggagcttatccttttgaggatcctgaagatccaaaaaatttcaggaaaaccattggaagaataatgagtgcccaattctccatacccgattatgtacgaatatctgcagattgtaaaaacctcctttcgcgaatctttgttgcaaatccctcgaagagaataactattcctgagataaagaaacatccttggtttttaaagaatctgccaaaagacttaatggatggtgagcattccaaatatgaagaggcttcagagcaactacagcaaagtgtggaggaaatcatgaggataatacaagaagctaagatacctggagaagtgtcaaaaccagaaggacaagctactgaaaggacaacagaacaagatgatacagaggatgatctcgaatcggaaattgatagcagcaatgattttgctgtttatgtctgaggatgacattatcaactggacttcgaaaagaacttaagtatgtaacttcttgagttgtttattatggtgtatagaaaactaattgtctggtggcttatacaatggttatgcagaaaactatatttatgagttctaaggtgtgcactcaaattattagatggatgtaatattgcagaaaacagatttctattttgtacctatcgatgatattctcccaaaaaaaaaaaaaaaaaaaaaa

SEQ ID NO: 556 - DNA, 1327 bp, Nicotiana sp.
gtcaaaattcaaaaaggaaaaaaagttagagttttttttttttgtctttcttgatttgggtatagaatggaggaaaaatatgagcttttgaaagaacttggtactgggaattttggggtggctaggctagttaaggacaagaagacaaaggagctttttgctgtcaaatatatagaaagagggaagaagattgatgaaaatgtgcagagagaaattataaatcatagatcgttgggacatccaaacattatcaggtttaaagaggtcttggtaactccatcgcatttagcaattgttatggagtatgcagcaggtggagaactttttgctagaatatgcagtgctggcagatttagtgaggatgaggctcgtttcttcttccaacagctaatatctggagtcagttactgtcatgccatggaaatttgtcacagggatttgaaactagaaaacactcttcttgatggaagtgcttcaccacgtgtaaaaatatgtgattttggttattccaagtctggattgttgcattcccaaccaaagtcgacagtaggaacacccgcttacattgcccctgaggtcctgtcacgaaaggaatatgacgggaagatagcagatgtatggtcatgtggggtgacgttgtatgtgatgctagtcggagcatatccttttgaggatcctgaagatccaaaaaatttcagaaaaaccattggaagaataatgagtgcccaatactccataccggattatgtacgaatatctgcagattgtaagaacctcctttcgcgaatctttgttgcaaatccctcaaagagaataactattcctgagataaagaaacatccttggtttttaaagaatctgccaaaagacttaatggatggtgagcattccaaatatgaagaggcttcagagcaactacaacagagtgtggaggaaatcatgaggataatacaagaagctaagatacctggagaagtgtcaaaaccagaaggacaagctactgcagggacagcagaaccagatgatactgaggatgacctcgagtcggaaattgacagcagcaatgattttgctgtttatgtctgaggatgacattatcaactggactaaaagagaacttcagtatgtaatcttgagttgtttattatggtgtatagaagacttagttatattctggcctaccgaactatatttatgagttctaaggtgtgcactcaaattgttagatggatgtaatattgcagaaaacagatttctattttgtacctatcgatgatattctctgctcctatgtgttaacaatcaatttttcagctgaattgatttt

SEQ ID NO: 557 - DNA, 1335 bp, Nicotiana sp.
gtcaaaattcaaaaaggaaaaaagktagagtytttttgtctttcttgatttgggtatagaatggaggaaaaatatgagcttttgaaagaacttggtactgggaattttggggtggctaggctagttaaggacaagaagacaaaggagctttttgctgtcaaatatatagaaagagggaagaagattgatgaaaatgtgcagagagaaattataaatcatagatcgttgggacatccaaacattatcaggtttaaagaggtcttggtaactccatcgcatttagcaattgttatggagtatgcagcaggtggagaactttttgctagaatatgcagtgctggcagatttagtgaggatgaggctcgtttcttcttccaacagctaatatctggagtcagttactgtcatgccatggaaatttgtcacagggatttgaaactagaaaacactcttcttgatggaagtgcttcaccacgtgtaaaaatatgtgattttggttattccaagtctggattgttgcattcccaaccaaagtcgacagtaggaacacccgcttacattgcccctgaggtcctgtcacgaaaggaatatgacgggaagatagcagatgtatggtcatgtggggtgacgttgtatgtgatgctagtcggagcatatccttttgaggatcctgaagatccaaaaaatttcagaaaaaccattggaagaataatgagtgcccaatactccataccggattatgtacgaatatctgcagattgtaagaacctcctttcgcgaatctttgttgcaaatccctcaaagagaataactattcctgagataaagaaacatccttggtttttaaagaatctgccaaaagacttaatggatggtgagcattccaaatatgaagaggcttcagagcaactacaacagagtgtggaggaaatcatgaggataatacaagaagctaagatacctggagaagtgtcaaaaccagaaggacaagctactgcagggacagcagaaccagatgatactgaggatgacctcgagtcggaaattgacagcagcaatgattttgctgtttatgtctgaggatgacattatcaactggactaaaagagaacttcagtatgtaatcttgagttgtttattatggtgtatagaagacttagttatattctggcctaccgaactatatttatgagttctaaggtgtgcactcaaattgttagatggatgtaatattgcagaaaacagatttctattttgtacctatcgatgatattctcsctcctatgtgttaacaatcaatttttcagctgaattgattttagtctttaaagtcct

SEQ ID NO: 558 - DNA, 1769 bp, Solanum lycopersicum; identical to SEQ ID NO: 464

SEQ ID NO: 559 - DNA, 1139 bp, Solanum lycopersicum
ggtttctttctttccagttagctagatttagacagcttcttcaaaatttatttgtaaaaaaaataaaatatttttatgtttgattattatttgaggtattaattgaaggtgaaatatttatagaaaatggaaagatatgaaattcagaaagacattggttctgggaattttggtgttgctaagcttgtgaaagataaatggagtggtgaactttttgctgtcaaatatattgaaagaggcaaaaagattgatgagcatgttcaaagggagataatgaatcacagatctttgaggcatccgaatatcattagatttaaggaggtatttctcacaccagctcatctagcaatagtgatggaatatgcttccggaggagagctttttgaacgaatatgcagtgctggaagattcagtgaagatgaggcaaggtttttctttcaacaacttatatcaggagtgagttattgtcattcaatgcaaatttgccacagagatcttaagcttgaaaacacattgttagacgggagctctacacaatgtctaaaaatatgcgattttggctattctaagtcagcagcattgcattcacaaccaaaatctacagttggaactccggcctatatcgcaccagaagtcttatcaagaaaagaatatgatggaaagatagcagatgtttggtcttgtggggtcacattatatgtgatgctggtcggcgcgtatccgtttgaagatcctgatgatccaagaaacttcaagaagacaataactaggatattaagcgtacaatattcgattccttactatgtccgagtctccaaggagtgtaatcacctcttatctcggatattcgtagctgatccagagaagaggataacgatcgaagaaataaagaagcatccatggttcttaaagaacttgcctaaagaatttatgaaaaaaggagaggaagctagtttagtacaaatgaatagtgaagaaaaaccattacaaagtattgaagaagcattggctataattcaagaagcaagaaaaccaggagagggatctaaagcaagtgattattttgttaacagcagcattagtatggatcttgatgattttgatactgatgctgatttagatgatgaaattgacacaaa

SEQ ID NO: 560 - DNA, 1810 bp, Solanum lycopersicum
aatcaattcaacacttattgaactttgaagccaacccctcaaatatttaattagttaaatattatacgtgttctttagtttaaccaatagaacattagattctcctattgttttatgtacatacttcaactgatttttgcattttgtcatcatatactataaatttgtggtataactgagagttgtttagaacaaggattggttagaaactgaacttttggttgttaaaaggttgaggttttttgaaaaaagattgagtctttttgttgttgttgatttgagttactcttttaaaggaaaaagattgagtctttttgttattcttgatttgggtatttcttataagggaaaaagattgagtttttttttttgttattgttgatttgggtatttcttttaagttgaaaaagatttgagtctttttgttattcttgacttgggtatttctttcaagtgaaaaaattgagttttgtctttcttgatttgggtatttcttaaaagtgaaaaagattgagtctttttgttattcttgatttgggtatttgtgttcctttgagtttgcgttttaagagcttgtgggtgtgtgatttagtgattttggattggataaaatggaggaaaaatatgagcttttgaaggaacttggtgctgggaattttggagtagcaaggttagttaaggataagaagacaaaggagcttttagctgtcaaatatatagaaagagggaaaaagattgatgagaatgtgcagagagaaattataaatcatagatcgttgaggcatccgaacattgtcaggtttaaagaggtcctggtaactccgtcgcatttggcaattgttatggagtacgcagcaggtggagaactttttggtagaatatgcagtgctggcagatttagtgaagacgaggctcgcttcttcttccaacagcttatatccggtgtcagctactgtcataccatggaaatttgtcacagggacttgaaacttgaaaacactcttcttgatggaagtccttcaccgcgtctaaaaatatgcgattttggttattccaagtctggtttactgcattcacaaccaaagtcgactgtgggaactcctgcttacattgcccctgaggtcctgtcacgaaaggaatatgatgggaagatcgcagacgtgtggtcatgtggagtgacactatatgtaatgttagtaggagcatacccttttgaggatcctgaagatccgaaaaacttcaggaaaaccattgggagaataatgagcgcccaacactccatacccgattatgtacgagtcacaccagattgcaggaacctcctttcgcgaatctttgttgcaaatccctctaagaggataactattcctgagataaagaaacatccttggttcttaaagaatctaccaaaagagctgatggatgttgagcacgcgagattcgaagaagcttcagagcaactacaacaaagtgttgaagaaatcatgaagatgatacaagaagctaaagtacctggagtagtgtcaaaatctgaagggaaagatcctgcagggacagcagaacaagatgatttagaggaagacctcgaatcggaaatcgacagcagcaatgactttgctgtttatgtctgaggatgaaattttatgatcaatttgaacttataagagaaaaaaatgtttaatatgttaactctttgtattgttaaaattatggctttgtatagatgagttatgcacagagctgctatttactgagttctaaagtgtgcatttcatttcatgtaatgtttgcaacaaacagattatgtaac

SEQ ID NO: 561 - DNA, 1864 bp, Solanum lycopersicum
aatcaattcaacacttattgaactttgaagccaacccctcaaatatttaattagttaaatattatacgtgttctttagtttaaccaatagaacattagattctcctattgttttatgtacatacttcaactgatttttgcattttgtcatcatatactataaatttgtggtataactgagagttgtttagaacaaggattggttagaaactgaacttttggttgttaaaaggttgaggttttttgaaaaaagattgagtctttttgttgttgttgatttgagttactcttttaaaggaaaaagattgagtctttttgttattcttgatttgggtatttcttataagggaaaaagattgagtttttttttttgttattgttgatttgggtatttcttttaagttgaaaaagatttgagtctttttgttattcttgacttgggtatttctttcaagtgaaaaaattgagttttgtctttcttgatttgggtatttcttaaaagtgaaaaagattgagtctttttgttattcttgatttgggtatttgtgttcctttgagtttgcgttttaagagcttgtgggtgtgtgatttagtgattttggattggataaaatggaggaaaaatatgagcttttgaaggaacttggtgctgggaattttggagtagcaaggttagttaaggataagaagacaaaggagcttttagctgtcaaatatatagaaagagggaaaaagattgatgagaatgtgcagagagaaattataaatcatagatcgttgaggcatccgaacattgtcaggtttaaagaggtcctggtaactccgtcgcatttggcaattgttatggagtacgcagcaggtggagaactttttggtagaatatgcagtgctggcagatttagtgaagacgaggctcgcttcttcttccaacagcttatatccggtgtcagctactgtcataccatggaaatttgtcacagggacttgaaacttgaaaacactcttcttgatggaagtccttcaccgcgtctaaaaatatgcgattttggttattccaagtctggtttactgcattcacaaccaaagtcgactgtgggaactcctgcttacattgcccctgaggtcctgtcacgaaaggaatatgatgggaagatcgcagacgtgtggtcatgtggagtgacactatatgtaatgttagtaggagcatacccttttgaggatcctgaagatccgaaaaacttcaggaaaaccattgggagaataatgagcgcccaacactccatacccgattatgtacgagtcacaccagattgcaggaacctcctttcgcgaatctttgttgcaaatccctctaagaggataactattcctgagataaagaaacatccttggttcttaaagaatctaccaaaagagctgatggatgttgagcacgcgagattcgaagaagcttcagagcaactacaacaaagtgttgaagaaatcatgaagatgatacaagaagctaaagtacctggagtagtgtcaaaatctgaagggaaagatcctgcagggacagcagaacaagatgatttagaggaagacctcgaatcggaaatcgacagcagcaatgactttgctgtttatgtctgaggatgaaattttatgatcaatttgaacttataagagaaaaaaatgtttaatatgttaactctttgtattgttaaaattatggctttgtatagatgagttatgcacagagctgctatttactgagttctaaagtgtgcatttcatttcatgtaatgtttgcaacaaacagattatgtaactttttaagttttaaccatttggtatccgtctaattcggattcacgttgtgtaaa

SEQ ID NO: 562 - DNA, 1417 bp, Triticum sp.; identical to SEQ ID NO: 466

SEQ ID NO: 563 - DNA, 1266 bp, Triticum sp.
cacactcctcctcccgcaccataccatcaatcaaggtgctcgagggacataggatcagaagaaagacgggaggatggatcggtacgaggtggtgagggacatcgggtccgggaacttcggggtggcgaagctggtgcgggacgtcaggaccaaggagcacttcgccgtcaagttcatcgagcgaggccacaagattgatgaacatgttcaaagggagattatgaaccaccggtcactcaagcatccaaatattattcgattcaaggaggtcgtgctaactcccacacatttggcaatagttatggaatatgcctctggcggcgagctatttcaaaggatttgcaacgcagggagatttagcgaggatgagggaaggttcttcttccaacaattgatttctggagtgagctattgtcactctatgcaagtatgccatagagatttgaaactagaaaatactctcttggatggtagtgttgcgcctcgactcaagatttgtgacttcggttactccaagtcttctgtcttgcactctcaaccgaagtcaactgtcggcacgccggcatacatcgccccggaggtcctctccagaagagagtatgatggaaaggtcgccgatgtttggtcttgtggagtaacgctctatgtgatgcttgtgggggcatatcctttcgaggaccctgatgagccaaggaacttccgcaaaactatcaccaggatactcagcgtacagtactccgttccggactacgttcgagtctcgatggattgcatacatctgttgtcccgcatcttcgttggaaatcctcagcagcgaataaccatcccggagatcaagaaccatccatggttcctcaagagattgcccgttgagatgaccgatgagtaccaaaggagcatgcatctggcagacatgaacacgccgtcacagagtctggaagaagccatggcgatcatccaggaggcgcagaaacctggcgataacgccctagggattgccgggcaggttgcctgcctggggagcatggatctagacgacatcgatttcgatatcgacgacattgatgttgagagcagcggggatttcgtgtgcccgttgtgacgctcatgagtggttcgaaagttctcttgatggtttacgtgtggatgtgttcctgtttgtcatgcttccatttagattttgttctggatcacaaattctctgtagcccacagattggccttgctgtgtaaacagtgtaagataagtctacatgtttttttttgg

SEQ ID NO: 564 - DNA, 1502 bp, Triticum sp.
  misc_feature (1435)..(1435): n is a, c, g, or t
  misc_feature (1438)..(1438): n is a, c, g, or t
gagccttcctcccctctcccccgccaggcccctcccgctccctctcctcgctcgggtgcttcctccctccctctgtccactccactcgccactggctccgttcggtccgtgaatcttgaccgacccgcctgagccggcagccaccggtggcctgctgccgcctctcgctccagtggtggtgtggctacgagctgcggacggagggggtccgggatggagcggtacgaggtgatcaaggacataggctcgggcaacttcggggtggccaagctggtccgggacgtcaggaccaaggagctcttcgccgtcaagttcatcgagagggggcacaagattgatgagaatgttcaaagggagattatgaaccacagatctctgaggcatccgaatattgttagattcaaagaggttgtgctaactcccacacatttggccatagttatggaatacgctgctggcggtgagctattcgaaaggatctgcagttctggaagatttagcgagaatgaggctaggttcttcttccaacaattgctttcaggagttagctattgccattccatgcaaatatgtcatagagatctgaaactagaaaacacactcctggatggaagcgaagcaccccggctcaagatatgtgatttcggttactccaagtcctctgtgttgcattctcaaccaaaatcaaccgtcggtactcctgcctacattgcccccgaggtcctttctagaagggaatatgatggaaaggtcgctgatgtctggtcgtgtggagtaaccctatatgtgatgcttgtcggcgcttatccttttgaggacccagacgaaccaaagaatttccgcaagacaattactcggatactcagcgtacaatatgcagtacccgattacgtccggatttcaatggagtgcaggcatttgctgtcccggattttcgtggcaaaccctgagcaacgaataaccatccaagagatcaagaaccacccatggttcctcaagaatctgccgatcgagatgaccgacgagtaccagatgagcctgcatatggtcggcgtcaacgctcccccgcagaccctggaggaggtcatggccatcatccaggaggcacggataccgggcgacggatccaagtttgccgggcagctgtcggttcccgggctagggagcatggagctcgatgacatagacgacgtcgacgcggacgtcgaggacagcggcgactttgtgtgcgcgttgtgacgggcaggtgtggttccccttggtggtgtggctttgtgtttgtaatgtgttcatccttctggtgtgtcgtctgttgcagagggttgcggtgtgctgttgtatgattacatgtgtttctgtaaccgttgttcgtagtgatgctgtggataaagtataagtataactatatacttccatatgtgtttggtgtcatcantangattcctggtgatctgattctctttacgcttcggcagtttatatatttgttactatttttttgc

SEQ ID NO: 565 - DNA, 1503 bp, Triticum sp.
gcctccctccctccctcaccttcctctctcccccctcccccgcccgctccctctcctcgctcgggtgcttcctccctcccggtgtccactccactcgccactggctccgttcggtgcttgaatcttgaccgacccgcctgagccggcagccaccggcggcctgctgccgcttgcttctcgctccagtggtgcctacgagctgcggacggacggacggacggacggagggggtccgggatggagcggtacgaggtgatcaaggacatagggtccggcaacttcggggtggccaagctggtacgggacgtcaggaccaaggagctcttcgccgtcaagttcatcgagagggggcacaagattgatgagaatgttcaaagggagattatgaaccacagatctctgaggcatccgaacattgttagattcaaagaggttgtgctaactcccacacatttggccatagttatggaatacgctgctggcggtgagctatttgaaaggatctgtggttctggaagatttagcgagaatgaggctaggttcttcttccaacaattgctttctggagttagctattgccattccatgcaaatatgtcatagagatttgaaactagaaaatacgctcctggatgggagcgaagcaccccggctcaagatatgtgatttcggttactccaagtcctctgtgttgcactctcagccaaaatcgaccgtcggtactcctgcctacatcgcccctgaggtcctttctagaagggaatatgatggaaaggtcgctgatgtctggtcctgtggagtaacactatatgtgatgcttgtcggcgcttatccttttgaggacccagacgaaccgaagaatttccgcaagacaattactgtgagttcatccaacaatcagctgcaccatatcctcattccattttgcttcactcagcgcatgccattaattatgcttgggagtaaaagtttataagatccttgcagaggatactcagcgtacaatactcggtacctgattacgtccggatttcgatggagtgcagacatttgctgtcccggattttcgtggcaaaccctgagcaacgaataaccatccaagagatcaagaaccacccgtggttcctcaagaatctgccgatcgagatgaccgacgagtaccagatgagcctgcacatggtcggcgtcaacgctcccccgcagaccctggaggagatcatggccatcatccaggaggcgcggataccgggcgacggttccaagttcgccgggcagctgtcggtgcccgggctagggagcatggagctggacgacatagacgacgtcgacgcggacgtcgaggacagcggcgacttcgtgtgcgcgttgtgacgagcaggcgtggcggttccccttggtggtgtggcctttgtgtttgtaatgtgttcatccttctgttgtgtcgtttgtttcagagggttgcgctgtgctgttgtatgattacatctgttttctgtaaccgttg

SEQ ID NO: 566 - DNA, 1461 bp, Triticum sp.
  misc_feature (1433)..(1433): n is a, c, g, or t
  misc_feature (1436)..(1436): n is a, c, g, or t
  misc_feature (1439)..(1439): n is a, c, g, or t
  misc_feature (1447)..(1448): n is a, c, g, or t
  misc_feature (1454)..(1454): n is a, c, g, or t
ctaactcccccccctctacctcaccttcctctcccccctcccccgcccgctccctctcctcgcccgggtgcttcctccctccctccctcctggtgtccactccactcgccactggctccgttcagttcttgaatcttgaccgacccgcctgggccggtggcctgctgccgcttctcgctccggtggtggctacgagctgcggacggacggacggagggggtccgggatggagcggtacgaggtgatcaaggacatagggtcgggcaacttcggggtggccaagctggtccgggacgtcaggaccaaggagctcttcgccgtcaagttcatcgagagggggcacaagattgatgagaatgttcagagggagattatgaaccacagatctctgaggcatccgaacattgttagattcaaagaggttgtgctaactcccacacatttggccatagttatggaatacgctgctggcggtgagctatttgaaaggatctgtggttctggaagatttagcgagaatgaggctaggttcttcttccaacaattgctttcaggagttagctattgccattccatgcaaatatgtcatagagatttgaaactagaaaatacgctcctggatgggagcgaagcaccccggctcaagatatgtgatttcggttactccaagtcctctgtgttgcactctcagccaaaatcgaccgtcggtactcctgcctacatcgcccccgaggtcctttctagaagggaatatgatggaaaggtcgctgatgtttggtcctgtggagtaactctatatgtgatgcttgtgggcgcttatccttttgaggacccagacgaaccgaagaatttccgcaagacaattactaggatactcagcgtacaatactcggtacctgattacgtccggatttcgatggagtgcagacatttgctgtcccggattttcgtggcaaaccctgagcaacgaataaccatccaagagatcaagaaccacccgtggttcctcaagaatctgccgatcgagatgaccgacgagtaccagatgagcctgcacatggtcggcgtcaacgctcccccgcagaccctggaggagatcatggccatcatccaggaggcgcggataccgggcgacggttccaagttcgccgggcagctgtcggtgcccgggctagggagcatggagctcgacgacatagacgacgtcgacgcggacgtcgaggacagcggcgactttgtgtgcgcgttgtgacgagcaggcgtggcggttccccttggtggtgtggcctttgtgtttgtaatgtgttcatccttctgttgtgtcgtttgtttcagagggttgcgctgtgctgttgtatgattacatctgttttctgtaaccgttgttggtagtgacgctgtggataaagtataagtataactatacttccatnaanaanagaaaacnnagcaanaagcttg

SEQ ID NO: 567 - DNA, 1550 bp, Triticum sp.
ctaackccycccycyctmcctcaccttcctctcccccctcccccgcccgctccctctcctcgcccgggtgcttcctccctccctccctcctggtgtccactccactcgccactggctccgttcggtccttgaatcttgaccgacccgcctgagccggcagccaccggtggcctgctgccgcttgcttctcgctccggtggtggctacgagctgcggacggacggacggacggacggagggggtccgggatggagcggtacgaggtgatcaaggacatagggtcgggcaacttcggggtggccaagctggtccgggacgtcaggaccaaggagctcttcgccgtcaagttcatcgagagggggcacaagattgatgagaatgttcaaagggagattatgaaccacagatctctgaggcatccgaacattgttagattcaaagaggttgtgctaactcccacacatttggccatagttatggaatacgctgctggcggtgagctatttgaaaggatctgtggttctggaagatttagcgagaatgaggctaggttcttcttccaacaattgctttcaggagttagctattgccattccatgcaaatatgtcatagagatttgaaactagaaaatacgctcctggatgggagcgaagcaccccggctcaagatatgtgatttcggttactccaagtcctctgtgttgcactctcaaccaaaatcaaccgtcggtactcctgcctacatcgcccccgaggtcctttctagaagggaatatgatggaaaggtcgctgatgtctggtcctgtggagtaaccctatatgtgatgcttgtcggcgcttatccttttgaggacccagacgaaccgaagaatttccgcaagacaattactcggatactcagcgtacaatactgcagtaccygattacgtccggatttcaatggagtgcagrcatttgctgtcccggattttcgtggcaaaccctgagcaacgaataaccatccaagagatcaagaaccacccatggttcctcaagaatctgccgatcgagatgaccgacgagtaccagatgagcctgcatatggtcggcgtcaacgctcccccgcagaccctggaggagatcatggccatcatccaggaggcgcggataccgggcgacggatccaagtttgccgggcagctgtcggttcccgggctagggagcatggagctcgacgacatagacgacgtcgacgcggacgtcgaggacagcggcgactttgtgtgcgcgttgtgacgrgcaggcgtggyggttccccttggtggtgtggcctttgtgtttgtaatgtgttcatccttctgktgtgtcgtytgttkcagagggttgcggtgtgctgttgtatgattacatgtgttttctgtaaccgttgttcgtagtgatgctgtggataaagtataagtataactatacttccatatgtgtttggtgtcatcagtaggattcctggtgatctgattctcttacgcttcggcagtttatatatttgttactatttttttgcaaaaaaaaaa

SEQ ID NO: 568 - DNA, 1919 bp, Triticum sp.
taattaatcgaacccatcccagcggggaagaagaagaagaagaagmagcctctccttctcctttaagcttcgaatcatccttccttcccccctccccctccctccctcccacttcatctcgccgcgacgaagcttccaaaacccccaaaaggatcccccaatcttcgcctctgcctccggcccgatcaagctctcagcagcggctgccgcgcggctcggcccgggatccatggagaggtacgagctgctcaaggacatcggcgccggcaacttcggcgtcgcgcggctgatgcggaacaaggagaccaaggagctcgtcgccatgaagtacatcccacggggcctcaagattgacgagaatgtggcgagggagatcataaaccaccggtcgctgcggcaccccaacataatccgattcaaggaggtggtggtcacgccgacgcacctggcgattgtgatggagtacgcggccggcggcgagctcttcgaccggatctgcaacgccgggaggttcagcgaggacgaggccaggtacttcttccagcagctcatctgcggcgtgagctactgccacttcatgcaaatttgccaccgggacctgaagctggagaacactctgctggacggcagcccggcgccccgcctcaagatctgcgacttcggttactcaaagtcgtcgttgctgcactcgaagcccaagtcgacggtcggcacgccggcgtacatcgccccggaggtgctctcccgccgggaatacgacggcaagacagccgatgtgtggtcttgtggagtgaccctttatgtgatgctagtcggcggttacccttttgaggatcctgatgaccccaagaacttcagaaagaccattgggagaataatgtcaatccaatacaaaataccggagtacgtccacgtatcccaagactgcaagcaactccttgccagtatttttgtcgcaaaccctgcaaagagaataacaatgagggagatcaggaaccacccctggttcttgaagaacttgccaagagagctcacggaagctgcccaagcaatgtactacaagagagacaacagcgccccgacctactcggtccagtccgtggaggagatcatgaagatcgtggaggaggcgcagaaaccgcctccttccaccactccggtggcgggtttcgggtgggcggaggaggacgagcaggaggatggcaagaagccagaggaggaagcggaggaggaagacgaggaagatgagtatgagaagcagttgaatgaggtccgtgccagcggtgagttccacatcagctagctgatgggggtgcttcactggcgtgagaaggccacagaccggggataaaatttgtcatatagtttgtagtttgtggttttgttctcgagtttttctcttcattcttgtctccgattctgcaacagtgtaaattaccaaagtggttccgtcgctgtctttacaatgactgattaagctagcattgcggaaacataatgtatggaataaatcatcttattgagcatgttcttgcacttcaaacctcgtgccgaattcggcacgaggaaacgaatgggcaagaacaccaatgttatttacgcacaccctgcagatgaagtggcggcaaaatccatgaccatgatgtgcttttgacccggtagttatacagatgtagaaccggctgttgagagggtgctgtgctgagttattatttgtttggaggggacgttgcatacagcggatgtattgtggcttgtcgaaaggaaattaacatttggttggttgtacagggatttatagaacttttttgcttagatcaatttcactttgtaagctgtgtattttgcagtgaatttttgcactcggttgattctgtggtcgttgccttagctataaawawwmwrtgcgactcgtatga

SEQ ID NO: 569 - DNA, 1307 bp, Triticum sp.
  misc_feature (1307)..(1307): n is a, c, g, or t
aggtttgctctgagttggtgcttctttcacagtcggtttcgttcgagttgaagccgcccttcgaaattctgtgattggggcgggtgggtggtggcgatggaggagaggtacgaggcgttgaaggagctggggacgggaaacttcggggtggcgaggctggtcagggacaagagcaccaaggagctcgtcgccgtcaagtacatcgagaggggcaagaagattgatgagaatgtgcagagggagatcatcaatcaccgctcgctccggcaccctaacatcatacgattcaaggaggtttgtgtaaccccgacgcaccttgccattgtcatggaatatgctgccggcggagaactcttcgaaagaatatgcaccgcagggcgattcagtgaagatgaggcaaggtacttcttccagcaactactttcaggggtcagctactgccattccatggaaatctgtcaccgtgatcttaaactggaaaacactctcctggatgggagtccaacacctcgagtgaaaatttgcgactttggttactcaaagtctgctttgctgcattccaaaccaaaatcaacggttggtactccagcatacatagcgccggaagttctttcgagaaaagaatatgacggcaaggtagcggacgtttggtcctgcggcgtgacattgtacgtgatgctcatcgggtcgtatccatttgaggaccccgaggatccaaggaacttccggaaaactatcagcagaatccttggcgtgcaatactccattccggactacgtcagggtgtcctccgactgcagacgcctcctgtcccaaatattcactgccgatccttcaaagaggatcacgatcgctgagatcaagaagctgccgtggtacctgaagagcctgcccaaggagatcgcggagagggacagggccaacttcaaggagcccgagacggagacggggaccgcggcggcggcggcgcagcccgtggaggagatcatgcggatcatccaggaggccaaggcccccggcgaaatgtccaagtcgtcggccgacgcggcgctgctcgccgagctggccgagctgcagagtgacgacgaggaggaggggccgggagccgagggggagacctactgactggactctgcatcgcagttcatacggtctgtctggagtacggtttgctgaaacaataataaggccacgaagcgtatgatacagattatgacacctgttctactatcgctgtgtacattattactgaacaacattgcaccgattttttaacttccaagaataaaagatggtggggatatacn

SEQ ID NO: 570 - DNA, 1084 bp, Arabidopsis thaliana
gatagaaaatcgtgtcgaccttttttctctcacttacccaataagagcttttttcgcgttttccaccgcaaccaccgtcaccttcaaccgccggagccgccgcaaggaaggctcatcatccgccgtggcaattttttgaggtgtacaaagcattgcctatttgacgaaccaggaaatggttaaaaggcatggagagttttgatttacaagatatatcatgtcgcagtgcatagacggtttcaagcatgtatgctcctcttttttccggtgttttgatatcgatatttacaaacaatctggaggccttggtgaccctgaacttcttgcgagagagacagtttttagcgtgagtgaaatagaggctctctatgagctgtttaagaaaatcagcagtgctgtgattgatgatgggctaataaacaaggaagaatttcagttagccttgttcaagacaaataaaaaagagagcttgtttgcagaccgggtattcgatttgtttgacacaaagcataatggaatactggggtttgaggagtttgcgcgtgctctctctgtctttcatccaaatgctcccatagaagacaagattgacttttcgtttcagctatatgatcttaagcagcaaggtttcatagagaggcaagaggtgaagcaaatggtggtggctactcttgctgagtccggcatgaacctgtcagacgaaatcatagagagtataatcgacaagacatttgaggaagctgatacaaaacatgacgggaggatcgataaggaagagtggagaacccttgttctcaggcatccttcccttctaaagaatatgactctccagtatcttaaggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctactcctgattttgattgctgattttct

SEQ ID NO: 571 - DNA, 1060 bp, Arabidopsis thaliana
gtcgaccttttttctctcacttacccaataagagcttttttcgcgttttccaccgcaaccaccgtcaccttcaaccgccggagccgccgcaaggaaggctcatcatccgccgtggcaattttttgaggtgtacaaagcattgcctatttgacgaaccaggaaatggttaaaaggcatggagagttttgatttacaagatatatcatgtcgcagtgcatagacggtttcaagcatgtatgctcctcttttttccggtgttttgatatcgatatttacaaacaatctggaggccttggtgaccctgaacttcttgcgagagagacagtttttagcgtgagtgaaatagaggctctctatgagctgtttaagaaaatcagcagtgctgtgattgatgatgggctaataaacaaggaagaatttcagttagccttgttcaagacaaataaaaaagagagcttgtttgcagaccggtaccaatcacaggtattcgatttgtttgacacaaagcataatggaatactggggtttgaggagtttgcgcgtgctctctctgtctttcatccaaatgctcccatagaagacaagattgacttttcgtttcagctatatgatcttaagcagcaaggtttcatagagaggcaagaggtgaagcaaatggtggtggctactcttgctgagtccggcatgaacctgtcagacgaaatcatagagagtataatcgacaagacatttgaggaagctgatacaaaacatgacgggaggatcgataaggaagagtggagaacccttgttctcaggcatccttcccttctaaagaatatgactctccagtatcttaaggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctaccc

SEQ ID NO: 572 - DNA, 1403 bp, Arabidopsis thaliana
tatagaaaatcgtgtcgaccttttttctctcacttacccaataagagcttttttcgcgttttccaccgcaaccaccgtcaccttcaaccgccggagccgccgcaaggaaggctcatcatccgccgtggcgtaaggctttttcttcttctctttctcccttttctacgatttcgcggtcggtcgcttcctcgtaatctcgtgtgtttattccgggaaaatcgcgatgggaaacaagttaaaatttgagattgagaatcaagcaactaatttcttcgcaagctgatagatccatgagctgattaccaagtttatataacgagattcatcgttgttgtatctctgaatccgaacgatttggaatctaaaactcattggatcgctttttctcatatccgtcatttctccttagcttaatcacttctctgattcatatcgcgattagattcagaattttttgaggtgtacaaagcattgcctatttgacgaaccaggaaatggttaaaaggcatggagagttttgatttacaagatatatcatgtcgcagtgcatagacggtttcaagcatgtatgctcctcttttttccggtgttttgatatcgatatttacaaacaatctggaggccttggtgaccctgaacttcttgcgagagagacagtttttagcgtgagtgaaatagaggctctctatgagctgtttaagaaaatcagcagtgctgtgattgatgatgggctaataaacaaggaagaatttcagttagccttgttcaagacaaataaaaaagagagcttgtttgcagaccgggtattcgatttgtttgacacaaagcataatggaatactggggtttgaggagtttgcgcgtgctctctctgtctttcatccaaatgctcccatagaagacaagattgacttttcgtttcagctatatgatcttaagcagcaaggtttcatagagaggcaagaggtgaagcaaatggtggtggctactcttgctgagtccggcatgaacctgtcagacgaaatcatagagagtataatcgacaagacatttgaggaagctgatacaaaacatgacgggaggatcgataaggaagagtggagaacccttgttctcaggcatccttcccttctaaagaatatgactctccagtatcttaaggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctactcctgattttgattgctgattttct

SEQ ID NO: 573 - DNA, 1145 bp, Arabidopsis thaliana
caactctctcctctgctttacaacaaatcgtctccgtcttcctcgctcagcttcaacaaccagagccgacttgagattgagaatcaacgtaatcgatactctcgcaaagtctcatcctttctcagcaaaaaacactaggaaatggttgaaaggcatggagagttttgatttgctgcttaagatatatcatgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcgtgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctgaaaaagcaaaagcaaaagcaagcagcggcaagacatcattgtattgttgaaggttgttctttcgttatggttctttatttgttacatttctaaatctctgaactcattttattttttattgagctttttttgtgaagcaaaattcttctttttagtttggtttttgtcctttttgatttcgctcggtctatctgtagatacaacttttgcatcttgatgttatggtaatgtaaagtttttcagtttatttattaatccaattaaaaagatttgcttc

SEQ ID NO: 574 - DNA, 1145 bp, Arabidopsis thaliana
gaactctctcctctgctttacaacaaatcgtctccgtcttcctcgctcagcttcaacaaccagagccgacttgagattgagaatcaacgtaatcgatactctcgcaaagtctcatcctttctcagcaaaaaacactaggaaatggttgaaaggcatggagagttttgatttgctgcttaagatatatcatgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcgtgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctgaaaaagcaaaagcaaaagcaagcagcggcaagacatcattgtattgttgaaggttgttctttcgttatggttctttatttgttacatttctaaatctctgaactcattttattttttattgagctttttttgtgaagcaaaattcttctttttagtttggtttttgtcctttttgatttcgctcggtctatctgtagatacaacttttgcatcttgatgttatggtaatgtaaagtttttcagtttatttattaatccaattaaaaagatttgcttc

SEQ ID NO: 575 - DNA, 1042 bp, Brassica sp.
attacatatttacatctcatctgcttttacattacagaccatcgcagtgttttgtttctgcatggagagttatgatttgcataaggtatcaatcatgacgcagtgcatagacggtgttaagcatttatgcacctctgttttagggtgttttgatctcaatttatttaaacaatctggtggtggccttggagatcctgaattactttctagagacacagtttttagtgtgagtgagatagaagctctttatgagctgtttaaaaaaaccagcagtgctgtgattgatgatgggcttataaacaaggaggagtttcagttggctttgtttaagacgaatgagaaagagagcttgtttgctgatcgagtttttgatttgttcgacacaaagcacaatggaatacttgggtttgaggagtttgctcgagctctctctgtmttycayccwaatgcrcctataratgacaaaatycacttttcatttcagctatatgatcttaaacarcaaggkttcatmgaacggcaagagstgaaacaaatggttgtggctacgcttgctgaatctggaatgaacttgaaggatactgtcattgaggatataatcgacaagacgtttgaagaagcagacacaaaacacgatgggaagattgataaagaagagtggagaagcctcgttcttagacatcccagcctgctcaagaacatgactcttcagtatctcaaggatatcacgactacgtttccaagctttgtgttccactctcaggttgaagatacctgatgatgaggaacaaaaacagcaagcattatatgtttttttcttgttcatttgtttcattgagttatctgatgtgaagcaaaatacaaatgaaatttctatgatttttgtttgtgtgaatcctatctctcttttcgattctgtctctttgatcagacctgtttgtaggtacaacgtatgcatcttggtatatgatctgtaaagttttcaacttcattgatccaaacaagtataggggtttgcttgtcttttgttatatttgatgaa

SEQ ID NO: 576 - DNA, 1352 bp, Hordeum vulgare
ggaaacaaaacgacgrrgcggagacgagaggcgtcccgttcgcgcacgctactcgattgattgcttccttccgcccgctgctccgctgccgccacagctcctccctcctcctcctgctcgagtcccccggtgccctagccagcccgctgccactggcggcgagcgagagtccggatcgcgggcgccgcgccgctccttcccctcccctaccggagggagaccccgccgaggatcgaggaccggccggccgcggaatgggcggccgcgatgactagcgggggtcgcgcggcggcgttgttggcggaggcagcggggcgcataccatggtgcagtgtctcgacggcgtcaagcacctcctcgcggtcctcttcaagtgctgcgacctcgagctcaagcagccccgggggctcgaggacccccaggtcctcgcgcgggagaccgtcttcagcgtgagcgaggtcgaggcgctgtacgagctcttcaagaagatcagcagcgccgtcatcgatgacgggctgattaacaaggaggagttccagttggcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccttctttactgaagaacatgactcttcagtatctcaaggacatcaccacgacatttccaagcttcgtctttcattctcaggtcgacgatacctgaaattcttgcagttctttcgaatcggaacataagaagataagcttgcagtaattttgtaaggttttggcatcggactgtttggaacattggatcggatgagagatagaggcattgctgctctgaaggatgttgaatttgagaacgcaaattgttgttaaataactttgcttcttccatttgaagaatttagaactgttgggagccttcgggcaaggtgttatctcttatctgaaattcccattttctcctctccccgtttttgttttttggctggttagcgatcaggtccaattctctgagaactctgctgtgtgtacagaaatgcaaacagccttgatattgttgtcatct

SEQ ID NO: 577 - DNA, 1336 bp, Hordeum vulgare
  misc_feature (1328)..(1329): n is a, c, g, or t
cggcacgagggtcccgttcgcgcacgctactcgattgattgcttccttccgcccgctgctccgctgccgccacagctcctccctcctcctcctgctcgagtcccccggtgccctagccagcccgctgccactggcggcgagcgagagtccggatcgcgggcgccgcgccgctccttcccctcccctaccggagggagaccccgccgaggatcgaggaccggccggccgcggaatgggcggccgcgatgactagcgggggtcgcgcggcggcgttgttggcggaggcagcggggcgcataccatggtgcagtgtctcgacggcgtcaagcacctcctcgcggtcctcttcaagtgctgcgacctcgagctcaagcagccccgggggctcgaggacccccaggtcctcgcgcgggagaccgtcttcagcgtgagcgaggtcgaggcgctgtacgagctcttcaagaagatcagcagcgccgtcatcgatgacgggctgattaacaaggaggagttccagttggcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccttctttactgaagaacatgactcttcagtatctcaaggacatcaccacgacatttccaagcttcgtctttcattctcaggtcgacgatacctgaaattcttgcagttctttcgaatcggaacataagaagataagcttgcagtaattttgtaaggttttggcatcggactgtttggaacattggatcggatgagagatagaggcattgctgctctgaaggatgttgaatttgagaacgcaaattgttgttaaataactttgcttcttccatttgaagaatttagaactgttgggagccttcgggcaaggtgttatctcttatctgaaattcccattttctcctctccccgtttttgttttttggctggttagcgatcaggtccaattctctgagaactctgctgtgtgtacagaaatgcaaacagccttgatattgtttgtcnnaaaaaaa

SEQ ID NO: 578 - DNA, 1350 bp, Hordeum vulgare
cgaccgacgaccacgggggcggacgggggcccctcggcgacggcggcgatcccctccgcccctctgctccgcgccgcaccggagaccccagccgcgatcctcccagccacgccgcgcccccgcgtggccgctcggctcgttcggccaaatccagcccaccgcccgcggggtcccgattggcggctagccgccccccgtggattgcgcggcgcccaccctggagagagagagagagagagagagagagagagagagagagagagagacgggcgttgacggacgggtgcggcgcgcagtggtggtgccaccatgttgcagtgcctggagggggtgaggcacctctgcggcgtgctcctcaagtgctgccacatcgacctcaagcatcccaagggcctggaggatcccgaggtcctcgccagggagaccgtgttcagcgtgagtgaggtcgaggcgctgtacgagctgttcaagaagatcagcagcgccgtgatagacgacgggctgatcaacaaggaggagttccagttggcgcttttcaagaccagtaagaaggagagcttgtttgctgaccgtgtctttgatttgtttgacacaaaacacaacggaattctaggatttgaagaatttgcccgtgccttatcagtatttcatccaagtgccgctcctgatgagaaaattaacttctctttccaactttatgatctgaagcagcaaggtttcattgaaagacaagaggttaagcaaatggttgttgctacacttgctgaatcaggaatgaatctttcagatgaagtcatagagagcatcattgataagactttcgaggaggcagacacaaaacatgatgggaaaattgacaaagaagaatggcacaatctagttcaaagacatccctcattactgaagaacatgacactccaatatctgaaggacatcaccaccacatttccaagctttgtgttccattctcaggttgccgatacctaaagtcctgagagcttcttcacttcgatggaatatcagaagacagtctcactgctttgctaagcctttccaatggccgtccgatggttcggaggaagctgtcgtagtgttccaaagcataccgcatactgtattcggttattccgctggtttctttgtgttcataacgtttttctttttcttttttagcttagggtgggctgctagtagatcagaatgttcaaagtttctttggtctttgtacaaaaaaagctggtttgaccctttagttaactgtgtatgtattctgtgtggggaactttcctactgtatattatggattgaactgaacggagcagaaatgcctttgttgataaagtttgtcgc

SEQ ID NO: 579 - DNA, 1389 bp, Hordeum vulgare
gccaccataccaatcgcaccaccagccgaccgacgaccacggcaccgacggcgacccctcggcgacggcggcgatcccctccgcccctctgctccgcgccgcaccggagaccccagccgcgatcctcccagccacgccgcgcccccgcgtggccgctcggctcgttcggccaaatccagcccaccgcccgcggggtcccgattggcggctagccgccccccgtggattgcgcggcgcccaccctggagagagagagagagagagagagagagagagagagagagagagagacgggcgttgacggacgggtgcggcgcgcagtggtggtgccaccatgttgcagtgcctggagggggtgaggcacctctgcggcgtgctcctcaagtgctgccacatcgacctcaagcatcccaagggcctggaggatcccgaggtcctcgccagggagaccgtgttcagcgtgagtgaggtcgaggcgctgtacgagctgttcaagaagatcagcagcgccgtgatagacgacgggctgatcaacaaggaggagttccagttggcgcttttcaagaccagtaagaaggagagcttgtttgctgaccgtgtctttgatttgtttgacacaaaacacaacggaattctaggatttgaagaatttgcccgtgccttatcagtatttcatccaagtgccgctcctgatgagaaaattaacttctctttccaactttatgatctgaagcagcaaggtttcattgaaagacaagaggttaagcaaatggttgttgctacacttgctgaatcaggaatgaatctttcagatgaagtcatagagagcatcattgataagactttcgaggaggcagacacaaaacatgatgggaaaattgacaaagaagaatggcacaatctagttcaaagacatccctcattactgaagaacatgacactccaatatctgaaggacatcaccaccacatttccaagctttgtgttccattctcaggttgccgatacctaaagtcctgagagcttcttcacttcgatggaatatcagaagacagtctcactgctttgctaagcctttccaatggccgtccgatggttcggaggaagctgtcgtagtgttccaaagcataccgcatactgtattcggttattccgctggtttctttgtgttcataacgtttttctttttcttttttagcttagggtgggctgctagtagatcagaatgttcaaagtttctttggtctttgtacaaaaaaagctggtttgaccctttagttaactgtgtatgtattctgtgtggggaactttcctactgtatattatggattgaactgaacggagcagaaatgcctttgttgataaagtttgtcgcaatttattgttttc

SEQ ID NO: 580 - DNA, 1104 bp, Hordeum vulgare
cacgaggcctcgtgccgaattcggcacgaggctcccacgaagccacgatacggagccatacccctccgatttcggcgccgtggtgtgtgtgacctgtgttgagctgttttctggcggagtgtgaaatggtggatttcccggaagggttgcgacggctcgctggtctcctactcaagtgctgcgatcttgacataccaaatcggcccaagggccttgaggatcctgagcgtctggcaagggaaacagtttttagcgtaaatgagattgaggcattatatgaattgttcaagaagattagtagtgccgtggttgatgatggtgtgattaataaggaagaattccaactggcgctgtttaagactaacaggaaagatagcatgtttgctgaccgggtgtttgatttgttcgacacgaagcacaatgggattctcgaatttgaagaatttgtgcgagctctttctgtattccatcctaatgcaccagttgatgacaaaattgattttgctttcaaactgtatgatctcaaacaacaaggtttcattgaaaaacaagaggtgaagcaaatggtggttgccacacttgctgaatcaggaatgaacctatctgatgaggttatagagggtattatcgacaagacatttgaggaagcagatacaaagcatgatggcaaaatcgacaaggaggaatggcgcaatcttgtcttgaggcatccatctttgttgaagaatatgacactcccatatctaagggatattaccacaacatttccaagctttgtcttcaactctcaggtcgaggatgcttgagaatccagtttctaggttaccactgaagcttgtgagaggccacggcagaccatgtcgtaggtggaccttgtgtatttttatttgtttattcctttttggtgatatccttgtgcttggaacaattcttgtaattttttcacttcttcaaaatgtgaattcccatcaatctcctcgtgtgagggttcttcttttgtatatacctgagtataaactagaatgaattgttccttatgtataaacgctcttcagatacccagttgcctgtgcgagtagcaactaaaagcactagttatatcca

SEQ ID NO: 581 - DNA, 1158 bp, Hordeum vulgare
  misc_feature (1051)..(1051): n is a, c, g, or t
cggcacgaggatggaaagtgccctcccacgaagccacgatacggagccatacccctccgatttcggcgccgtggtgtgtgtgacctgtgttgagctgttttctggcggagtgtgaaatggtggatttcccggaagggttgcgacggctcgctggtctcctactcaagtgctgcgatcttgacataccaaatcggcccaagggccttgaggatcctgagcgtctggcaagggaaacagtttttagcgtaaatgagattgaggcattatatgaattgttcaagaagattagtagtgccgtggttgatgatggtgtgattaataaggaagaattccaactggcgctgtttaagactaacaggaaagatagcatgtttgctgaccgggtgtttgatttgttcgacacgaagcacaatgggattctcgaatttgaagaatttgtgcgagctctttctgtattccatcctaatgcaccagttgatgacaaaattgattttgctttcaaactgtatgatctcaaacaacaaggtttcattgaaaaacaagaggtgaagcaaatggtggttgccacacttgctgaatcaggaatgaacctatctgatgaggttatagagggtattatcgacaagacatttgaggaagcagatacaaagcatgatggcaaaatcgacaaggaggaatggcgcaatcttgtcttgaggcatccatctttgttgaagaatatgacactcccatatctaagggatattaccacaacatttccaagctttgtcttcaactctcaggtcgaggatgcttgagaatccagtttctaggttaccactgaagcttgtgagaggccacggcagaccatgtcgtaggtggaccttgtgtatttttatttgtttattcctttttggtgatatccttgtgcttggaacaattcttgtaattttttcacttcttcaaaatgtgaattcccatcaatctcctcgtgtgagggttcttcttttgtatatacctgagtataaactagaattaattgttccttatgtataaacgctcttcagatccnggaaaaagaagaaagaggggtcttttggggggggccaaatcctttcaccgggggggcccctttattttatcgcggccccccggggggggccccgtcccatttttctt

SEQ ID NO: 582 - DNA, 1303 bp, Gossypium sp.
gcggccggggtccacaacccttatcaccatcgttttcattccccatttaactcacacccagtttcatagattttctatactaccccaacattactctctctaggtattaccataattttcccttcaattctgttttcttttctctgtttgtttctcgagaaaagtacctaacttttttcttttcttttttgaaaatctacgtgagcttaaaaaattcagattcttacattttgagcttcagtgcagaatcaggaaatggttaaaaggtatggagtgttttgatgtgtggaagatatcatgttgcagtgcgtagctggtgtgaagcatttatttgcttctgtactgcaatgttgtgatattgatttgtacaaacaatctagaggtctcggtgatcccgaacttcttgcacgagagactgtgtttagtgtaagtgaaatagaagctctttacgagctgttcaagaagataagtagcgcggtgatagatgatgggctgattaacaaggaggagttccaattagcattattcaaaacaaacaaaaaggagagcttgtttgcagatcgggtatttgacttgtttgatacaaagcataatggaattctaggttttgaagagtttgctcgtgcgctctctgtcttccatccgaatgcacccattgaagataagattgagtgtatgtgttgtctacaccgagatctttatttgcatctttggccatcgttcataaacttggagatcagattctcttttcaactatacgatctcaagcaacaaggtttcattgagaggcaggaagtgaagcaaatggtagtggctacgcttgctgaatcaggcatgaacctttcggatgatgttatagaaagtataatcgacaagacctttgaggaagctgatacgaaacacgatggaaggattgacaaggaagagtggagaagccttgttatacgacatccgtcccttctgaaaaacatgaccctgcaatacctcaaggacatcacaacaacattcccgagcttcgtttttcactcacaagttgatgatacctgaatgcaactggattcaaagcttgttcctatccatggacgtttcaaatcaaaatggccaaaagagtgagttcctatgatgttgttttggttcattggtttaaaatttatccttcttatgtgtgttcatattcaactgttgaacattcttgttttcgtcaattggccgatcgccgtttgccatttgagtctcggacatgctggaatccagtgttttttttccctctatggtgttacaatgtacattttcttcttttttc

SEQ ID NO: 583 - DNA, 1247 bp, Gossypium sp.
ccaacattactctctctaggtattaccatcattttcccttcaattctgttttcttttctctgtttgtttctcgagaaaagtacctaacttttttcttttcttttttgaaaatctacgtgagcttaaaaattcttacattttgagcttcagtcagcagaatcaggaaatggttaaaaggtatggagtgttttgacgtgtggaagatatcatgttgcagtgcgtagctggtgtgaagcatttatttgcttctgtactgcaatgttgtgatattgatttgtacaaacaatctagaggtctcggtgatcccgaacttcttgcacgagagactgtgtttagtgtaagtgaaatagaagctctttacgagctcttcaagaagataagtagcgcggtgatagatgacgggctgattaacaaggaggaatttcaattggcattattcaaaacaaacaaaaaggagagcttgtttgcagatcgggtatttgacttgtttgatacaaagcataatggaattctaggttttgaagagtttgctcgtgcgctctctgtcttccatccgaatgcacccattgacgataagattgagttctcttttcaactatacgatctcaagcaacaaggtttcattgagaggcaggaagtgaagcaaatggtagtggctacgcttgctgaatcaggcatgaacctttcggatgatgttatagaaagtataatcgacaagacctttgaggaagctgatacaaaacacgatggcaggattgacaaggaagagtggagaagccttgttttacgacatccatcccttctgaaaaacatgaccctgcaatacctcaaggacatcacaacaacattcccgagcttcgtttttcattcacaagttgatgatacctgaatgcaactggattcaaagcttgttcctatccgtggacgtttcagatcaaaatggctaaaagagtgagttcctatgatgttgttttggttcattggtttaaaatttatccttcttatgtgtgttcatattcaactgttgaacattcttgttttcttcaattggccgatcgccgtttgccgtttgagtctcggacatgctggaatccagtgtttttttccctttatggtgttacaatgtacattttcttcttttttcaaaagggttctttccatttttattttctagtattggatatggaaccacttagtagtggatgtaaataaacttggatttggcaaataaattacttttccccctc

SEQ ID NO: 584 - DNA, 1131 bp, Gossypium sp.
cacaccttcactgtaaactcaccgccggtttcgtagcttttatatagtacccctaagcactctcttcttaacaaaagctttatcagattccgactccaatatttggtattcagtcagcagaatcaggaaatggttaaaaggtatggagtgtattgatgtgaagagaataccatgttgcagtgcatagacggattgaagcatttatttgcttcagtgctgcaatgctgtgatattgatttgtacaagcaatcaagaggtcttgttgatcctgaacttcttgcaagagagaccgtttttagtgtaagtgaaatagaagcactttatgagcttttcaagaagataagcagtgctgttatagatgatgggctgatcaacaaggaggagttccaattggcgttattcaaaacaaacaaaaaggagagtttgtttgctgatcgggtatttgacttgtttgatacaaagcataatggaattctaggtttcgaagagtttgctcgtgctctctctgtcttccatccaaatgcgcccattgacgataagattgatttctcttttcaactatacgatctcaagcagcaaggttttattgagaggcaggaggtgaagcaaatggtagtggctaccctagctgaatctggcatgaacctttcagatgatgttatagaaagtataattgacaagacctttgaggaagctgatacaaaacatgacgggaggatcgacaaggaagagtggagaagccttgttttgcgacatccatcccttctgaaaaatatgaccctgcaataccttaaggacatcaccacaacgttcccaagctttgttttccactctcaagttgatgatacctgagatcagcaattcgattcaagcttccatagaccggcttgtttcattctaggtggtttcaaatatgaatgccccaagagctagtgtatgtgatattctggtttattggttaaaaacaattcctagtgtgggtctaaattcaacagttgaacaatcgtcatcttctttttcttcttcttgtcagtgttattggataattggtacttccagacgtgctgaaatatttaggttgtatttttcactatggtattgcatgtaaaagtgatgctccctttggttttt

SEQ ID NO: 585 - DNA, 1534 bp, Gossypium sp.
gcggccggggtccacaacccttatcaccatcgttttcattccccatttaactcacacccagtttcatagattttctatactaccccaacattactctctcccaacattactctctctaggtattaccataattttcccttcaattctgttttcttttctctgtttgtttctcgagaaaagtacctaacttttttcttttcttttttgaaaatctacgtgagcttaaaaattcttacattttgagcagattcttacattttgagcttcagtctgcagaatcaggaaatggttaaaaggtatggagtgttttgatgtgcggagaatatcatgttgcagtgcttagacggattgaagcatttatttgcttctgtactgcaatgttgtgatattgatttgtacaagcaatccagaggtctcgaggatcctgaacttcttgcaagagagacagtttttagtgtaagtgaaatagaagcactttatgagctcttcaagaagataagcagtgcagtgatagatgatgggctgattaacaaggaggagtttcaattggcgttattcaaaacaaacaaaaaggagagcttgtttgcagatcgggtatttgacttgtttgatacaaagcataatggaattctaggtttcgaagagtttgctcgtgctctctctgtcttccatccaaatgcacccattgacgataagattgagtgtatgtgttgtctacaccgagatctttatttgcatctttggccatcgttcataaacttggagatcagattctcttttcaactatacgatctcaagcagcaaggtttcattgagaggcaggaggtgaagcaaatggtagtggctacgcttgctgaatctggcatgaacctttcagatgatgttatagaaagtataattgacaagacctttgaggaagctgatacaaaacatgatgggaggattgacaaggaagagtggagaagccttgttttgcgacatccatcccttctgaaaaatatgaccctgcaataccttaaggacatcacaacaacattcccgagcttcgtttttcattcacaagttgatgatacctgaatgcaactggattcaaagcttgttcctatccgtggacgtttcagatcaaaatggctaaaagagtgagttcctatgatgttgttttggttcattggtttaaaatttatccttcttatgtgtgttcatattcaactgttgaacattcttgttttcttcaattggccgatcccgtttgccgttcgacgttcgagtctcggacatgctggaatccagtgttttttttcccctctatggtgttacaatgtacattttcttcttttttcaaaagggttctttccatttttattttctagtattggatatggaaccacttagtagtggatgtaaataaacttggatttggcaaataaattacttttcmccatcacaaagaaaaaaaaaaaactgagaagttctaggtagacgggcgcggacccataagttaggcacccggtggggagccaaaaaagtgacccag

SEQ ID NO: 586 - DNA, 1017 bp, Gossypium sp.
aacaattcggcacgaggaataggaaatggttaaaaggtatggactgtattgatgtgaagagaataccatgttgcagtgcatagacggattgaagcatttatttgcttcagtgctgcaatgctgtgatattgatttgtacaagcaatcaagaggtcttgttgatcctgaacttcttgcaagagagaccgtttttagtgtaagtgaaatagaagcactttatgagcttttcaagaagataagcagtgctgttatagatgatgggctgatcaacaaggaggagttccaattggcgttattcaaaacaaacaaaaaggagagcttgtttgctgatcgggtatttgacttgtttgatacaaagcataatggaattctaggtttcgaagagtttgctcgtgctctctctgtcttccatccaaatgcgcccattgacgataagattgatttctcttttcaactatacgatctcaagcagcaaggttttattgagaggcaggaggtgaagcaaatggtagtggctaccctagctgaatctggcatgaacctttcagatgatgttatagaaagtataattgacaagacctttgaggaagctgatacaaaacatgacgggaggatcgacaaggaagagtggagaagccttgttttgcgacatccatcccttctgaaaaatatgaccctgcaataccttaaggacatcaccacaacgttcccaagctttgttttccactctcaagtcgatgatacctgagatcagcaattcgattcaagcttccatagaccggcttgtttcattctaggtggtttcaaatatgaatgccccaagagctagtgtatgtgatattctggtttattggttaaaaacaattcctagtgtgggtctaaattcaacagttgaacaatcgtcatcttctttttcttcttcttgtcagtgttattggataattggtacttccagacgtgctgaaatatttaggttgtatttttcactatggtattgcaatgtaaaaagtgatgctc

SEQ ID NO: 587 - DNA, 1319 bp, Gossypium sp.
  misc_feature (353)..(353): n is a, c, g, or t
gatttaaaaataaaaaaccaaagggagcatcactttttacattgcaataccatagtgaaaaatacaacctaaatatttcagcacgtctggaagtaccaattatccaataacactgacaagaagaagaaaaagaagatgacgattgttcacctgttgaatttagacccacactaggaattgtttttaaccaataaaccagaatatcacatacactagctcttggggcattcatatttgaaaccacctagaatgaaacaagccggtctatggaagcttgaatcgaattgctgatctcaggtatcatcaacttgagagtggaaaacaaagcttgggaacgttgtggtgatgtcctnaaggtattgcagggtcatatttttcagaagggatggatgtcgcaaaacaaggcttctccactcttccttgtcgatcctcccgtcatgttttgtatcagcttcctcaaaagtctgtcgaaaagctccaaaacttaacatgtagaagctaaaccccataaaattttagaagcaatacgacttcaattaaatcaaattgaatgatcaccttgtcaattatactttctataacatcatctgaaaggttcatgccagattcagcaagcgtagccactaccatttgcttaacctcctgcctctcaatgaaaccttgctgcttgagatcatatagttggaaagagaagtcaatcttatcgtcaataggagcatttggatggaagacagaaagagcacgagcgaactcttcgaaacctagaattccattatgctttgtatcaaacaagtcaaacacccgatctgcaaacaagctctcctttttgtttgtcttgaataacgccaattgaaactcctccttgttaatcagcccatcatctatcactgcactgcttatcttcttgaagagttcatagagtgcttctatttcacttacactaaaaactgtctctcttgcaagaagttcaggatcctcgagacctctggattgcttgcacaaatcaatatcacaacagtgcaatacagaagcaaataaatgcttcaatccgtctaagcactgcaacatgatattctccgcgcatcaaaacactccatacctgttaaccatttcctgattctgcagactgaagctgaaatgtcggagccagaattgtgaggagtcgtatacttggtgacctcaactccaaaacaatatcttaagctcacagagatttcaaaaaccgttccttctcaattttctcggaaaacagagaagaataatgaatttatggaagcaaaaacatgtaattgcctattttgggggagattgaatgggtg

SEQ ID NO: 588 - DNA, 1236 bp, Gossypium sp.
ccataatacactcattcaatctcccccaaaataggcaataacatgtttttgcttccataaattcattattcttctctgttttccgagaaaattgagaaggaacggtttttgaaatctctgtgagcttaagatattgttttggagttgaggtcaccaagtatacgactcctcacaattcaggctccgacatttcagcttcagtctgcagaatcaggaaatggttaacaggtatggagtgttttgatgcgcggagaatatcatgttgcagtgcttagacggattgaagcatttatttgcttctgtattgcactgttgtgatattgatttgtgcaagcaatccagaggtctcgaggatcctgaacttcttgcaagagagacagtttttagtgtaagtgaaatagaagcactctatgaactcttcaagaagataagcagtgcagtgatagatgatgggctgattaacaaggaggagtttcaattggcgttattcaagacaaacaaaaaggagagcttgtttgcagatcgggtgtttgacttgtttgatacaaagcataatggaattctaggtttcgaagagttcgctcgtgctctttctgtcttccatccaaatgctcctattgacgataagattgacttctctttccaactatatgatctcaagcagcaaggtttcattgagaggcaggaggttaagcaaatggtagtggctacgcttgctgaatctggcatgaacctttcagatgatgttatagaaagtataattgacaaggtgatcattcaatttgatttaattgaagtcgtattgcttctaaaattttatggggtttagcttctacatgttaagttttggagcttttcgacagacttttgaggaagctgatacaaaacatgatgggaggattgacaaggaagagtggcgaagccttgttttgcgacatccctcccttctgaaaaatatgaccctgcaataccttaaagatatcacgacgacattcccaagctttgttttccactcgcaagtcgatgatacctgaaatcagcaaatggatgaaagctttcatatggcctacttcattctaggcaatggtggcagattcaaatataaatgggcggccaaagagtattaaaataagcatcttgaaaaaagggggctgatgccaaaatagtagatcttgtcattcataaaggtattattataattataatcttgtttaggataaacataaaaagaaaaaa

SEQ ID NO: 589 - DNA, 1074 bp, Vitis sp.
  misc_feature (4)..(4): n is a, c, g, or t
cggntcggaattccgggtcgaccacgcgtccggtgagacatggtgggcgggcatcttcactcttcctcttcaggctttctctgcaggtatggagcattttgatgtgccaaaaatatcatgttgcagtgcttagagggatttaagcatttaattgcttccctactgcggtgttgtgatcttgatttgtataatcaagcaagaggtcttcaagatcctgaagttcttgcaagggaaacagtgtttagtgtaagtgaaatcgaggcactatacgagctgtttaagaagatcagcagtgctgtgattgatgacggtctgatcaacaaggaagagtttcaattggctttgttcaaaacaaacaaaaaggaaagcttatttgctgatcgggtatttgacttgtttgacacaaagcataacggaatacttggctttgaggagtttgctcgtgctctatctgtttttcaccccaacgcacctatcgacgacaagattgagttttcttttcagttatacgatctcaagcagcagggtttcattgagaggcaggaggtgaagcaaatggtagtggccacacttgctgaatctggtatgaatctttcggatgatgttatagaaagtatcattgacaagacctttgaggaagctgacacaaaacatgatggaaagattgacaaagaagagtggagaagccttgttctacgacacccatcccttttgaagaatatgactcttcaatacctcaaggacatcaccaccacattcccaagctttgtctttcattctcaagttgacgacacctgaagtcccatacatgaaagttgactggtttttgttaataattgcatctctatttctaaatgatataggccccttgtgtgtcgtaaagggcctaacaggaagtcttcactttgtaatgtttgttactatgggtggtgggtgtgatcatttatgccaaagaactagactctttccctttttagtagataaggtttcatagtgtgtgaacttgcaactcacattgtttgaatttttttgtgttcaacttatctactggatgggtaaacatacttgctctct

SEQ ID NO: 590 - DNA, 1583 bp, Vitis sp.
accgccgtagtagtccttttattcgttttctttatcttattttcagtcctttttaaaaaaaatttaatttaatcaatttcaatcatttggttgcttagagaaataaatcttacttttgataataataataagaaaaattctgagagaaaaagagagatagtgagagacatgttggaaaatcttcagtccaccaccaccgctacctactccgcctccggcatccgctcgccacagccgcggttcttctaaaggtatggagtgttttgacttctggaaaagatcatgttgcagtgcctagagggagtgaagcatctgtgtgctgttgtagtaaattgttgtgatgctgatctatataaacaacctaagggacttgaagatcccgaagctcttgcaagggagacagtatttagtgtaagtgaaatagaagcactttatgaactgtttaagaagatcagcagtgctgtaattgatgatggcctcatcaacaaggaagaatttcaactggcgttatttaagacaaacaaaaaggagagtttgtttgcagaccgggtatttgacttgtttgacacaaagcacaatggaatactagattttgaagagttcgcgcgtgccctctctgtctttcatcccaatgcacccattgaagacaaaattgacttttcatttcaactgtatgatctaaagcaacaagggttcattgaaagacaggaggtcaagcagatggtagtggctacgcttgctgaatctggcatgaatctttcagatgatgtaatagaaagtatcattgataagacctttgaggaagctgatactaaacatgatgggaagatagacaaggaagaatggcgaagccttgttttgcgacatccatctcttttgaagaatatgacccttcaatacctaaaagacatcaccactacattcccaagttttgtgtttcactcacaagtggatgacacttgagttgcagagctacatcaagttctatcatcttgagcagggatggtttgtttctcctagacaatatggcccttctgtgtgcagtggtgttcagaagaaacttcctgagagttaaattacacacagttacttggatgttggctttgtgttcatatttccagtaactagacctttgtgttcctttttggataaatgaggctttttttagtttttaacagaagggggatgtgcttgctgtttaattatttaatgtgcttttttttttggggggtaaaaaaaaagtaatattcttgttaggacttgtcatacttctttcttgcttgccatggatctgacggtagaccaagcattcaatcagcttgcgctttgtttgctagcctccgcaggttcaaatcacagtcactgcctctttttctccagtgtagcgggatgaacgggatcaggactttgctggaccatgctgctatgtttcactggtttccagtgctacgatggcttttcctttccaggaacatgacccgctttctctgaagtagttatctggtttgcttcgaacttaccagcatgcccatgtaatttcatgcaatttatgtgaaatcaaaagctttctgttcaaaaaaaac

SEQ ID NO: 591 - DNA, 1084 bp, Vitis sp.
tttttttttttgatcgatcgatcgggggcggatgatagacagtgagacatggtgggcgggcatcttcactcttcctcttcaggctttctctgcaggtatggagcattttgatgtgccaaaaatatcatgttgcagtgcttagagggatttaagcatttaattgcttccctactgcggtgttgtgatcttgatttgtataatcaagcaagaggtcttcaagatcctgaagttcttgcaagggaaacagtgtttagtgtaagtgaaatcgaggcactatacgagctgtttaagaagatcagcagcgctgtgattgatgacggtctgatcaacaaggaagagtttcaattggctttgttcaaaacaaacaaaaaggaaagcttatttgctgatcgggtatttgacttgtttgacacaaagcataacggaatacttggctttgaggagtttgctcgtgctctatctgtttttcaccccaacgcacctatcgacgacaagattgagttttcttttcagttatacgatctcaagcagcagggtttcattgagaggcaggaggtgaagcaaatggtagtggccacacttgctgaatctggtatgaatctttcggatgatgttatagaaagtatcattgacaagacctttgaggaagctgacacaaaacatgatggaaagattgacaaagaagagtggagaagccttgttctacgacacccatcccttttgaagaatatgactcttcaatacctcaaggacatcaccaccacattcccaagctttgtctttcattctcaagttgacgacacctgaagtcccatacatgaaagttgactggtttttgttaataattgcatctctatttctaaatgatataggccccttgtgtgtcgtaaagggcctaacaggaagtcttcactttgtaatgtttgttactatgggtggtgggtgtgatcatttatgccaaagaactagactctttccctttttagtagataaggtttcatagtgtgtgaacttgcaactcacattgtttgaatttttttgtgttcaacttatctactggatgggtaaacatacttgctctcca

SEQ ID NO: 592 - DNA, 1482 bp, Zea mays
cgcccccgggaggccgggagagaagagaacacgcgcgtcaggagcgcacaccgcacggcgcacacacacacgcctcccgcggcaagcagcgcaggacaccgacgacgaagcgaggagaggggaggaggcggagccgagcgcccgagcccaaccccgcaaccacgacccacttccccgtcgcgattcgcattgcccttccctcgggttctacccccagcctcgcgccgccgccgccgccgccgcccttgccagagagatcaccccccattcccacaatcccgtccctccctccgtccctcgaggagccgagccctccgcgcggccgtgggatggggcagtgaccggtgagtggcgtggggagccggtgggcggtggcgagggcatatcatggtgcagtgcctggacggggtgaggcagctgctcgcggtcctgctcaattgctgcgacgtcgagctcaagcagccgcgggggctccaagacccccaggtcctcgcgagggagaccgtcttcagcgtgagtgaggtcgaggcgctgtacgagctgtttaagaggatcagcagcgccgtcattgatgatgggctgattaacaaggaggaatttcagttggcgctatttaagaccaacaagaaggagagcctgttcgcggatcgcgtatttgatttatttgacacaaagcacagtggaattttgggatttgaagaatttgctcgtgctctctcagtatttcatcctaatgctccccttgatgagaaaattgatttttcattccggctgtatgatctcaagcagcaaggctatattgagagacaagaggttaagcagatggttgttgcaacacttgccgagtcaggaatgaatctttcggatgaaattgtagagagtataattgacaagacatttgaggaggcagacacaaagcatgatggaagaattgacaaggaagagtggcgcaatctagtcattcggcatccttctttgctgaagaacatgactcttcagtacctcaaggacatcaccactacatttccaagctttgtctttcactctcaggttgatgataactgaaattgatggggttactttgaaaagaaacattagaagatattctcatgggttctgatatggttttcatttttcaaaattgggttgttggattgaaagattgtagtgttgtgaagtacgtgcatgttggattcgaggactcgattttttttgtcaaccttgtttctttcatttgcatgtctggatgcgcatgaataagatatgaagtttatgtctaaagttttcttttttttccttgttttctttggctggccggcaatcggatccagtttttagaagcttgtctttctgtacaggatagaaacagcgttttaaggatttatattgtccttgtacttttttctgctgtagctagagcagaatattttttggttgaagggggcgtgcttccattttttaatatatgggtgttttattttc

SEQ ID NO: 593 - DNA, 1412 bp, Zea mays
aagagaacwcgsgcggccgggcgsrcykykcamscsgacccgcacaccgacgaaagagaggagaggaggcggagctcgagcccaaccgcgcaactcacttccccgtcgcgatttgcattgccctcctcttggcccccgatctcgccgtgccctacccccagcctcgctccgccgccaccagagagatagcgccccccattcccacaatctaatccttccgtccctcgaggagccgagccctccgcgcggccgtgggatggggcggtgacaacaccggtgagtggcgtggggcagggagccggtggcgagggcatatcatggtgcagtgcctggacggggtgaggcagctgctcgcggtcctgctcaattgctgcgacgtcgagctcaagcagccgcccgggctcgaggaccctcaggttctcgcgagggagaccgtcttcagcgtgagcgargtcgaggctctstacgagctgttcaagaagataagcagtgctgtcatcgatgatgggctgattaacaaggaggagtttcagttggcrctatttaagaccarcaagaaggagagcctgttcgcggatcgcgtatttgatttatttgacacaaagcacagtggaattttrggatttgaagaatttgctcgtgctctctcagtatttcatcctaatgctccccttgatgagaaaattgacttttcattccggctgtatgatctcaagcagcaaggctacattgagagacaagaggttaagcagatggttgttgctacacttgctgagtcaggaatgaatctttcagatgaaattgtagagagtataattgacaagacatttgaggaggcagacacaaaacatgatggaaggattgacaaggaagagtggcgcagtctagtcagtcggcatccatctttgctgaagaacatgactcttcagtacctcaaggacatcaccactacatttccaagctttgtctttcactctcaggttgatgataactgaaattgatggggttactttgaaaagaaacattagaagatattctcatgggttctgatatggttttcatttttcaaaattgggttgttggattgaaagattgtagtgttgtgaagtacgtgcatgttggattcgaggactcgattttttttgtcaaccttgtttctttcatttgcatgtctggatgcgcatgaataagatatgaagtttatgtctaaagttttcttttttttccttgttttctttggctggccggcaatcggatccagtttttagaagcttgtctttctgtacaggatagaaacagcgttttaaggatttatattgtccttgtacttttttctgctgtagctagagcagaatattttttggttgaaggtgcgtgcttccattttttaatatatttgtgttttatcttta

SEQ ID NO: 594 - DNA, 1360 bp, Zea mays
tcaccgtttcatcctctttccccaatccgttcaacgacggcttcaggaaccctttttccggcggccgccacaacgagcctcgggcaccgcaaagcaaatcctatcctatcagtcggatcgtgcgtctcgtcgagcctcgatcctatccccgccacgccgatccctcgtcggtcgtccgaatctggtggactatctccatcgccgggcgttcatttttggcccggtgagccgggggtggggggtgggtatttggtgccgtgagttgctgctcccgcccgtcgatgcttggttagcagaagagacggcggcggtaccatgttgcagtgcctggatggagtgaagcagctccttggcgtgctcctcaagtgctgccacatcgacctcaagcagcccaacggcctagaggatccggaggtgctcgctagggagaccgtgtttagcgtgagcgaggtcgaggcattgtatgagctgttcaagaagatcagcagtgctgtgattgatgatgggctgatcaacaaggaggagtttcagttggcgctgttcaagactaataagaaggaaagtttttttgctgatcgggtatttgacttatttgatacaaaacacaatgggattcttggatttgaagaatttgctcgggcgctctcagtatttcatcccaacgctcccttggatgagaagattgagttttcattccaactttatgacctcaagcaacaaggcttcattgaaagacaggaggtacagcaaatggttgttgctacacttgcggagtcaggaatgaatcttttagatgaggtcatagagagcatcattgataagacttttgaggaggcagacacaaagcatgatgggaaaattgacaaagaagaatggcgcaatttagtagtgaggcatccctctttattgaagaacatgacactacaatatctcaaggacatcaccactacatttccgagctttgtcttccattctcaggtcgatgatacctgaatttctgaaaactaatgaatgtcagaaggtggactgcttgctttgccaagcaaactttcagtgcctgtttgatggttcaaaaatctcatcgtcctgaaggcatcaaatcatcgtttgttgttaataatctttttccttgttttttatttggaattcttgctggattctgtgtgaatcctcttctattttccctctccattgttcctttattctatttcggttttgatggccagtacttgagtcagttaatgtgtacaaagttgcgtctgatgctgcctgtcattgaattgtatggcatgtgaggaagatttaaattgtatattcaccttcctttaaaggatagttgcacatatttttaccatccttc

SEQ ID NO: 595 - DNA, 1470 bp, Zea mays
ccggccgggccggggaaacaattaaaaaaaaaaaaaaaaaaaaaaaaawwmgrmacgwycctgaaaaaaaaaacacgaagaactccaccgtttcatcctctttccccaatccgttcaacgacggcttcaggaacccttcctccggcggccgccacaacgagcctcgggcaccgcaaagcaaatcctatcctatcagtcggatcgtgcgtctcgtcgagcctcgatcctatccccgccacgccgatccctcgtcggtcgtccgaatctggtggactatctccatcgccgggcgttcatttttggcccggtgagccgggggtggggggtgggtatttggtgccgtgagttgctgctcccgcccgtcgatgcttggttagcagaagagacggcggcggtaccatgttgcagtgcctggatggagtgaagcagctccttggcgtgctcctcaagtgctgccacatcgacctcaagcagcccaacggcctagaggatccggaggtgctcgctagggagaccgtgtttagcgtgagcgaggtcgaggcattgtatgagctgttcaagaagatcagcagtgctgtgattgatgatgggctgatcaacaaggaggagtttcagttggcgctgttcaagactaataagaaggaaagtttgtttgctgatcgggtatttgacttatttgatacaaaacacaatgggattcttggatttgaagaatttgctcgggcgctctcagtatttcatcccaacgctcccttggatgagaagattgagttttcattccaactttatgacctcaagcaacaaggcttcattgaaagacaggaggtaaagcaaatggttgttgctacacttgcggagtcaggaatgaatcttttagatgaggtcatagagagcatcattgataagacttttgaggaggcagacacaaagcatgatgggaaaattgacaaagaagaatggcgcaatttagtagtgaggcatccctctttattgaagaacatgacactacaatatctcaaggacatcaccactacatttccgagctttgtcttccattctcaggtcgatgatacctgaatttctgaaaactaatgaatgtcagaaggtggactgcttgctttgccaagcaaactttcagtgcctgtttgatggttcaaaaatctcatcgtcctgaaggcatcaaatcatcgtttgttgttaataatctttttccttgttttttatttggaattcttgctggattctgtgtgaatcctcttctattttccctctccattgttcctttattctatttcggttttgatggccagtacttgagtcagttaatgtgtacaaagttgcgtctgatgctgcctgtcattgaattgtatggcatgtgaggaagatttaaattgtatattcaacttttgtggtcatgatagttgcacatatttttaccatcctttctaatttatatttgttatttttttc

SEQ ID NO: 596 - DNA, 1185 bp, Zea mays
aagagaacacgcgcggcacgggcgcaccgcgcaccccgaccccgcacaccgacgacgaagagaggagaggaggcggagctcgagcccaaccgcgcaactcacttccccgtcgcgatttgcattgccctcctcttggcccccgatctcgccgtgccctacccccagcctcgctccgccgccaccagagagatagcgccccccattcccacaatctaatccttccgtccctcgaggagccgagccctccgcgcggccgtgggatggggcggtgacaacaccggtgagtggcgtggggcagggagccggtggcgagggcatatcatggtgcagtgcctggacggggtgaggcagctgctcgcggtcctgctcaagtgctgcgacgtcgagctcaagcagccgcccgggctcgaggaccctcaggttctcgcgagggagaccgtcttcagcgtgagcgaagtcgaggctctctacgagctgttcaagaagataagcagtgctgtcatcgatgatgggctgattaacaaggaggagtttcagttggcactatttaagaccagcaagaaggagagcctgttcgcagaccgcgtatttgatttgtttgacacaaagcacaatggaattttaggatttgaagaatttgctcgtgctctctcagtatttcatcctaatgctccccttgatgagaaaattgacttttcattccggctgtatgatctcaagcagcaaggctacattgagagacaagaggttaagcagatggttgttgctacacttgctgagtcaggaatgaatctttcagatgaaattgtagagagtataattgacaagacatttgaggaggcagacacaaaacatgatggaaggattgacaaggaagagtggcgcagtctagtcagtcggcatccatctttgctgaagaacatgactcttcagtacctcaaggacatcaccacaacatttccaagctttgtctttcactcccaagttgatgataactgattttcatgggattattttggcaagaagcattagaagatattctcgtggggttctgatatggttttctttttcaattattgggttgttggattgactgagatcgtagtgctcataagtatgttggatgttggattcgagaactcaaatcttttgtcaaccatgtttctttcatttgcatgtctggat

SEQ ID NO: 597 - DNA, 1259 bp, Zea mays
agttaccgttgacgtggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaggctctgtatgagctgttcaagaagattagcagtgctgtggttgatgatggcttgattaacaaggtttgtaggttctaagctcttagtgtgaagtggcagtgaatgacaactttgtttccatgaagtcattgtgtctgatctctccttggagctttgatgtattatctgcaggatgaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatgacaaaattgattttgctttcaaattgtatgatctcaagcaacaaggtttcattgaaaagcaggaggtcaagcaaatggtggtcgcaacacttgctgaatcaggaatgaatctttcagatgatattattgaaggcattattgataaaacatttgaggaagcagatacaaagcacgacggcaaaattgataaggaggaatggcgcagccttgtcttgaggcatccatctctgttaaaaaatatgaccctcccatatctccgggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtcgctgtttataaaatattcttcaaacatattgctcataaaaaactactcaaagtaagaatcaaattgagtacaaaactactcaaagtaag

SEQ ID NO: 598 - DNA, 1804 bp, Zea mays
  misc_feature (1742)..(1742): n is a, c, g, or t
  misc_feature (1781)..(1781): n is a, c, g, or t
gtagctaaacaaggctgacgtgctcctcctccggcgattcgctcccttcctcttcccccggccacgcacttccccgccccccgaccccgcaacctctcaccgccggtccccgccctccgaccctccacgcgcaaatagcccgcctccatccactaggaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaggctctgtatgagctgttcaagaagattagcagtgctgtggttgatgatggcttgattaacaaggatgaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatgacaaaattgattttgctttcaaattgtatgatctcaagcaacaaggtttcattgaaaagcaggaggtcaagcaaatggtggtcgcaacacttgctgaatcaggaatgaatctttcagatgatattattgaaggcattattgataaaacatttgaggaagcagatacaaagcacgacggcaaaattgataaggaggaatggcgcagccttgtcttgaggcatccatctctgttaaaaaatatgaccctcccatatctccgggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtcgctgtttataaaatattcttcaaacaaaaaaaaaaaaaaaaaaaccgagactagttctccctctctctctcgggaaccgagggagtcgtgtctgtgcgagtgtgccatggcgggcgaggggtcagaccctgcctgcctccccgcccccggtgccgccgccaccgaagcggagaaagatcgagccgcctaggaggtttcggtgggtgtgctggcagcgggagtcgatctcgacaaaagctagaaaggcaaagagatatccgccgtccttcaagcgcagcgtgagggagatgccttggaagctacaaaggcttcggttccctctttgggaagaatcaccttgttcctgtcatcccaacgaacgactgacgaacaagaatggcaatttgtaaggctgtgaataccgagcaggatgacccttgctgtttcctttaagagcgcgacctgataccgcatactaagctatggacattaacattacattgatcgtaaggtgacagcacgaagttactgtcagctcasaagtcaagtaattactaccaagctgtacgtatgccghcccccaacttgcaggatctcgacagcgacraaaggtacagattttcctgcacrtttgcagatctaagatctaagcggwgawaaarctttgcatggyggcsagcatatgttggtgtgcgttagctttccntttttttttctagtgggaattggtatccggtccttgctnccaccccaccctacgtctgagga

SEQ ID NO: 599 - DNA, 1211 bp, Prunus persica
  misc_feature (759)..(759): n is a, c, g, or t
  misc_feature (780)..(780): n is a, c, g, or t
  misc_feature (960)..(960): n is a, c, g, or t
  misc_feature (1169)..(1169): n is a, c, g, or t
  misc_feature (1210)..(1210): n is a, c, g, or t
cacattcgtagcctccatatataaacaggagattcgctacatagctgcacagagatcgcataccatcgccctccaagaacacagctgctcagccacagcgctcttccttctccctctctctctctctctcaaattcagctatctatcaaaacagatatagctttggctgctccaaattttacggatcttggatttgggcgtgagttagaagaagtaggaaatggttaaaaggtttgttttgatatttacatgctttaggatcctttcttttaaagatagacttaaaggaaatttcatgatttgtttttcatttttccatgtgaaccaggtatggagtgttttgatctgcagaaaatatcatgttgcagtgcatagaggggttaaagcatttatgtgcttccctactgaggtgctgtgatcttgagttgtacaagcaatcaagaggcttagaagaccctgaaattctagcaagggagacagtgttcagcgtgagtgaaatagaggcactatatgagctatttaagaagattagcagtgcagtgattgatgatggattgattaacaaggaggagtttcaactggcattattcaagacaaacaagaaagagagcttgtttgctgatcgtgtatttgacttgtttgacacaaagcacaatggaatactaggttttgaagagtttgcacgagccctctctgtctttcatcctaacgccccaattgacgataagattgagttttcttttcaattatatgacctcnagcaacaaggcttcattgaanggcaggaggtgaagcaaatggtagtcgctacccttgcagaatctggcatgaatctttcagatgatgtgatagaaagtataattgataagacctttgaggaagccgatactaaacatgatgggaggatcgacaaggaagagtggagaagccttgttttgcggcacccatcccttcttaaanatatgacgctgcaatacctcaaagacatcaccacaacatttccgagctttgtatttcactcacaagtggacgacacctgaaatttgaaaatttccaattttaagctccaagggacatcattttttaattaacttgatgtggttttgcatgtttctgaagagaatgtggcccactccactcttatgtaaagggccaagaagaaatttttnacatcatttttcgttgtttcttttgaatattttttggctgng

SEQ ID NO: 600 - DNA, 1246 bp, Populus spp
tgagagrmatgwmyaaraatcttgacttctcttcaccttcccttcttaaccttctttcctctcgtttgattttctgaaaggtatggagtgttttgacgcctggaaaagatcatggcgcagtgcctagacagaataaagcatttttgtgctgctgtagcaagctgttgtgatgcggatttgtataagcaaaacagagggctggaagatccagaagctcttgcaagggaaacagtgtttagtgtgagtgaaatagaagcgytgtatgaactgtttaagaagatcagyagtgcagtsattgatgaygggctgatcaataaggaagaatttcaactagcattattcaagacaaataaaaaggaaagcctattcgcagatcgggtatttgacttatttgacacaaagcacaatggaatattagattttgaggagtttgcacgcgctctctctgtatttcaccccaatgcaccaattgatgataagattgaattttcattccaactgtatgatctcaaacagcaagggtttattgagagacaggaggtaaagcaaatggtagtggctacacttgctgaatctggtatgaatctgtcggatgatgtaatagagagcattattgataagacatttgaggaggctgatactaagcatgacgggaagattgataaagaagaatggcgaagccttgttttgcgacatccctctcttttgaagaatatgactctccagtatctcaaggacatcaccaccacattcccaagttttgtgtttcactcacaagttgatgatacctgagttgtagatgtgaacaagttttactgatgtagtttaaaagaaatgtgcggttgtgcgtgccaaggtttcctagatatagggagaatgtcatcttgtgttttagagctgcaatgactagagcatgctctccattttgcattagattagatttctacctggaacaaatcggttcctgctgttgtttctttctttcttgcgtttgaatggggtaaatttcatgcttgcaattaagctttgatttagttttttgagattttggcctcagtttaatctctgctctctacaagcttgtcacttgcttggcctttaacctattacaatgcccatctcttgtaatgccgtgccattagccattttaatgctgctctccatgtacaagaaagagagacctgttggattcttcaggctgttgaagaaattgatataaaattagaacctgctacctgattatccg

SEQ ID NO: 601 - DNA, 1366 bp, Populus spp
ggtaccaacctaaacaacgagtcgcttggaataattgaatttaatttcaaatatctctttccatttgatattttcttatcataaattaatctctcgtatgccgaatccaagttgacgcacttgtaatcaaattccttgaaggagcagttgcacagatttcccgagtcaaaaagatactctacaaggtatactcttgagagcccaagtatttcttttgctgaacttaattgtggaattggctagcagaagcaggaaatggtgaaaaggtatggagtgtttccaagcatatgatttatcatgtaccagtgtgtagagcgatccattacctccctcctgcggtgtttggatatcgatctatacaaatcaagaggccttgaggatcccgagcttcttgcgagggagacagtcttcagtgtaagtgaaatagaggcattatatgagctctttaagaagatcagcagtgccgtgatagatgatgggctgatcaataaggaggagtttcaattggcgttgttcaagacaaacaaaaaggagagtttgtttgctgatagggtgtttgacttgtttgatacaaaacacaatgggatactaggttttgaagagtttgcccgtgccctctctgtatttcatccaaatgccccaattgaggagaagattgagttttctttccaactttatgatctaaagcagcaaggttttattgaaagacaggaggtgaagcaaatggtagtagctacgcttgctgaatctggtatgaacctttcagatgatgttatagaaagtataattgacaagacctttgaggaagctgatacaaaacatgacgggaagattgacaaagaagagtggagaagccttgttttacgccatccatcccttctgaagaatatgacccttcaatacctcaaggacatcaccactacattcccaagctttgttttccactcacaagtcgacgacacctgaattcgagacatctgtattcaaagctcgcagactttgttattttatgttttgtttctccacagacgtgatgggcgggggagcatggttctttggctcctgagggcaaatttcatcatgatgttgatataggcacgcagttggggaggcctcacggctagttttagcattaaggcttctaagcggcagaaaaagttgctgtaccactgatttagtaaggatacggttgatcaggccattaaaatgcttagatgttcaccttccaaagcatgaatgattcttaaatggttggtacggtagtgacttccatgcctctgcgtctggactacatttacacttctggttgtgataacttgggagctttggactcctttgaatttctaatgcatgagtttatgtgtgg

SEQ ID NO: 602 - DNA, 1499 bp, Populus spp
ttacggccggggatgatctagtagcgtcgcaattgcacacaacctaaatatcgagtcgctttgaatagttgaattaaatttcaaatatctctttccatttttttttctttttctaaatttatctctcgtattccaaatccaagtttacatacttgaatcaaattccttgaaggagcagttgcacagattttccgagttaaaaagattctctacaaggtatactcttgagagcccaagtttttcttttgctgaacttaattgtgggattggctagcagaagcaggaaatggtgaaaaggtatggagtgttttcaagcatatgatttatcatgttccagtgtgtagagggattcattacctccctcctgcggtgttttgatattgatctatacaaatcaagaggccttgaggatcctgagcttcttgcgagggagacagtcttcagtgtaagtgaaatagaggcattatatgagctctttaagaagatcagcagtgccgtgatagatgatgggctgatcaataaggaggagtttcaattggcgttgttcaagacaaacaaaaaggagagtttgtttgctgatagggtgtttgacttgtttgatacaaaacacaatgggatactaggttttgaagagtttgcccgtgccctctctgtatttcatccaaatgcccctattgatgataagattgcgttttctttccaactttacgatctaaagcagcaaggttttattgaaagacaggaggtgaagcaaatggtagtggctactcttgctgaatctggtatgaacctttcagatgatgttatagaaagtataattgacaagacctttgaggaagctgatacaaaacatgatgggaagattgacaaagaagagtggagaagccttgttttacgccatccatcccttctgaagaatatgacccttcaatacctcaaggacatcaccactacattcccaagctttgttttccactcacaagtcgacgacacctgaattcgagacatctgtattcaaagctcgcagactttgtttttttatgttttgtttctccacagacgtgatgggcgggggagcatggttctttggctcctgagggcaaatttcatcatgatgttgatataggcacgcagttggggaggccccacggctagttttagcattaaggcttctaagcggcagaaaaagttgctgtaccactgatttagtaaggatacggttgatcaggccattaaaatgcttagatgttcaccttccaaagcatgaatgattcttaaatggttggtacggtagtgacttccatgcctctgcgtctggactacatttacacttctggttgtgataacttgggagctttggactcctttgaatttctaatgcatgagtttatgtatgtataccttattaccttcctacgttgagcaaggcgtggcccttgactgcgtcacagctggacttcatatacgattcaaatgaatagcgagctttagtgattctc

SEQ ID NO: 603 - DNA, 1041 bp, Populus spp
ggcacgagggaaatgtctaaaaatcttgacttctcctcctctttccttctttcctctcccttgtttccctaaaaggtatggagtgttttgacgtctggaaaagatcatggtgcagtgcctagacggattaaagcatttgtgtgctgctatagcaaactgttgtgatgcagatttgtataagcaacccagagggctggaagatccagaagatcttgcaagggaaacagtgtttagtgtgagtgaaatagaagcgctgtatgaactgtttaagaagatcagcagtgcagtgattgatgacgggctgatcaataaggaagaatttcaactagcattattcaagacaaataaaaaggaaagcctattcgcagatcgggtatttgacttatttgacacaaagcacaatggaatattagattttgaggagtttgcacgcgctctctctgtatttcaccccaatgcaccaattgatgataagattgaattttcattccaactgtatgatctcaaacagcaagggtttattgagagacaggaggtaaagcaaatggtagtggctacacttgctgaatctggtatgaatctgtcggatgatgtaatagagagcattattgataagacatttgaggaggctgatactaagcatgacgggaagattgataaagaagaatggcgaagccttgttttgcgacatccctctcttttgaagaatatgactctccagtatctcaaggacatcaccaccacattcccaagttttgtgtttcactcacaagttgatgatacctgagttgtagatgtgaacaagttttactgatgtagtttaaaagaaatgtgcggttgtgcgtgccaaggtttcctagatatagggagaatgtcatcttgtgttttagagctgcaatgactagagcatgctctccattttgcattagattagatttctacctggaacaaatcggttcctgctgttgtttctttctttcttgcgtttgaatggggtaaatttcatgcttgcaattaagctttgatttagttttttcccaa

SEQ ID NO: 604 - DNA, 1041 bp, Populus spp
ggcacgagggaaatgtctaaaaatcttgacttctcctcctctttccttctttcctctcctttgtttccctaaaaggtatggagtgttttgacgtctggaaaagatcatggtgcagtgcctagacggattaaagcatttgtgtgctgctatagcaaactgttgtgatgcagatttgtataagcaacccagagggctggaagatccagaagttcttgcaagggaaacagtgtttagtgtgagtgaaatagaagcgctgtatgaactgtttaagaagatcagcagtgcagtgattgatgacgggctgatcaataaggaagaatttcaactagcattattcaagacaaataaaaaggaaagcctattcgcagatcgggtatttgacttatttgacacaaagcacaatggaatattagattttgaggagtttgcacgcgctctctctgtatttcaccccaatgcaccaattgatgataagattgaattttcattccaactgtatgatctcaaacagcaagggtttattgagagacaggaggtaaagcaaatggtagtggctacacttgctgaatctggtatgaatctgtcggatgatgtaatagagagcattattgataagacatttgaggaggctgatactaagcatgacgggaagattgataaagaagaatggcgaagccttgttttgcgacatccctctcttttgaagaatatgactctccagtatctcaaggacatcaccaccacattcccaagttttgtgtttcactcacaagttgatgatacctgagttgtagatgtgaacaagttttactgatgtagtttaaaagaaatgtgcggtcgtgcgtgccaaggtttcctagatatagggagaatgtcatcttgtgttttagagctgcaatgactagagcatgctctccattttgcattagattagatttctacctggaacaaatcggttcctgctgttgtttctttctttcttgcgtttgaatggggtaaatttcatgcttgcaattaagctatgatttagttttttcccaa

SEQ ID NO: 605 - DNA, 1563 bp, Oryza sativa
ccccccccccccccccaaatgcggaaaccaagcgagtacaagtagacgcacgcgcacacgcatacgcatcgcagccagttcatcctcgattcctcccccgaatttccttcgcgatctcaccccgcgtgccctagctagctatcgaatcccgtcacctcggcggcggcggcgagatcggagctccgggttaacctcctccaccgcgaggcgtggaacctctctctctctcgctctctccacctgaggatcgaagatcgaaacccctggcaccggctcgggccgcggaatgggcggccgcggtgagtagctaggtctgcggcggcggagttgttgttgttggtggtggtggtggtggaggaggagttggcggcggagggggcgggggcgttggtggtggtggtggtgggagagtatcatggtgcagtgtctcgacggggtgaggcagctgctggcggtcgtgttcaagtgctgcgacctcgagctgaagcagccgcgggggctcgaggatccccaggtcctcgcgagggagaccgtcttcagcgtgagcgaggtcgaggcgctgtacgagctcttcaagaagataagcagtgctgtgattgatgacgggctgattaacaaggaggagtttcagttggcgctgttcaagaccagcaagaaggagagcctgttcgccgaccgtgtatttgatttgtttgacacaaaacacaatggaattttaggatttgatgaatttgctcgtgcactctcagtatttcatccaagtgctccacttgatgagaagattgacttttcattccagttatatgatctcaagcaacaaggctatattgagagacaagaggttaagcagatggttgttgctacacttgctgagtctggaatgaatctttctgatgaaattatagagagcataatcgataagacatttgaggaggcagacacaaagcatgatggaagaattgataaagaagagtggcgcaatctggttcttcgtcatccctctttgctgaagaacatgactctccagtacctcaaggacatcaccactacatttccaagctttgtcttccattcccaggtcgatgacacctgaattcttggatttgtttgaactcaaaccatcagaagaatgctcatgccggttcattaagaattttgatattgggttgttggattgggcagagactccagagctctgtaggatgttgcatgttcgatttgagaagttctcaaatctttaaattgatgtaactttgtttctttcgtttggaagtttagtgtggctggagactttcggggagatgttaaatttctgtctgaatccgtagatcctttattctcttcccctcttttctgtttttctggctagcaatcagaatatcttttctgtttttttggctagcaatcagaatatcggatatagttttgtgaatctttcattttgcgtacaaaataggaaccttcaaaaaaattgatcgtgctggaaaatgttctgttggagtttgcaaattgcaatgatcatgaaatgctctccttttttgagagtttgcaccatactgtcat

SEQ ID NO: 606 - DNA, 1552 bp, Oryza sativa
ccccccccccccccccaaatgcggaaaccaagcgagtacaagtagacgcacgcgcacacgcatacgcatcgcagccagttcatcctcgattcctcccccgaatttccttcgcgatctcaccccgcgtgccctagctagctatcgaatcccgtcacctcggcggcggcggcgagatcggagctccgggttaacctcctccaccgcgaggcgtggaacctctctctctctcgctctctccacctgaggatcgaagatcgaaacccctggcaccggctcgggccgcggaatgggcggccgcggtgagtagctaggtctgcggcggcggagttgttgttgttggtggtggtggtggtggaggaggagttggcggcggagggggcgggggcgttggtggtggtggtggtgggagagtatcatggtgcagtgtctcgacggggtgaggcagctgctggcggtcgtgttcaagtgctgcgacctcgagctgaagcagccgcgggggctcgaggatccccaggtcctcgcgagggagaccgtcttcagcgtgacgaggtcgaggcgctgtacgagctcttcaagaagataagcagtgctgtgattgatgacgggctgattaacaaggaggagtttcagttggcgctgttcaagaccagcaagaaggagagcctgttcgccgaccgtgtatttgatttgtttgacacaaaacacaatggaattttaggatttgatgaatttgctcgtgcactctcagtatttcatccaagtgctccacttgatgagaagattgacttttcattccagttatatgatctcaagcaacaaggctatattgagagacaagaggttaagcagatggttgttgctacacttgctgagtctggaatgaatctttctgatgaaattatagagagcataatcgataagacatttgaggaggcagacacaaagcatgatggaagaattgataaagaagagtggcgcaatctggttcttcgtcatccctctttgctgaagaacatgactctccagtacctcaaggacatcaccactacatttccaagctttgtcttccattcccaggtcgatgacacctgaattcttggatttgtttgaactcaaaccatcagaagaatgctcatgccggttcattaagaattttgatattgggttgttggattgggcagagactccagagctctgtaggatgttgcatgttcgatttgagaagttctcaaatctttaaattgatgtaactttgtttctttcgtttggaagtttagtgtggctggagactttcggggagatgttaaatttctgtctgaatccgtagatcctttattctcttcccctcttttctgtttttctggctagcaatcagaatatcttttctgtttttttggctagcaatcagaatatcggatatagttttgtgaatctttcattttgtgtacaaaataggaaccttcaaaaaaattgatcgtgctggaaaatgttctgttggagtttgcaaattgcaatgatcatgaaatgctctccttttttgagagtttgcatc

SEQ ID NO: 607 - DNA, 1474 bp, Oryza sativa
ggaagaaaatcacgcaaagaaagggaaaaaaaataactcgaagagtccgttttttcttcctcctactcgccccaatccaatccactccaccgtaccactcgccgccgccgccgccgccgacgacgaagccggcgccgccgccggagccgatcccccgcgggcccaccctcctacttcgcgcttcctcggccgaaatccctaccgggtcgaatcgccccgcggcgcgccgctgatccgcgccgccgcgccctagccatcccggggacgggcggcggctgctgctgctgctgccgatgcatggttggtggtggcgggtaggtgagtaagagagtaggcgtaccatgttgcagtgtctggagggggtgaagcagctctgcggcgtgctactcaagtgctgcgacctcgacctcaagcagcccaaggggctcgaggatcccgaaatcctcgccagggagaccgtctttagtgtgagcgaggttgaggcgttgtatgagctgttcaagaagatcagcagcgcggtgatcgatgacggactgatcaacaaggaggagtttcagttggcgctgttcaagaccaacaagaaggagagtttatttgctgaccgtgtatttgatttgttcgatacaaaacacaatggtattttaggattcgaagaatttgcccgtgcgctctcagtatttcatccaaatgcacctctcgacgagaaaattgacttttctttccagctatatgacctcaagcaacaagggttcattgaaagacaagaggttaagcaaatggttgttgcaacacttgctgagtcgggaatgaatctttcggatgaagtcatagagagcatcattgataagacatttgaggaggccgacacaaaacatgatgggaaaattgataaagaagaatggcgcaatctagttctcagacatccttctttactgaaaaacatgacactccaatatctcaaggacatcacaactacatttccaagctttgtcttccattctcaagtcgacgatacttgaaatctgagaatttccccctccaatggaatgccagaagacagtctcgttgcttttgaggctttgcaatgagtagtttttggttcagcacttcatctgaagccataaagttccagagatgatcacatattgcagtggagaaatcaaacatttccgtattgttaataatagttctttttcttgcttttagccggtgtgtgatatctgtctcaagtttcttttccctattttctgtttttttttctttctgttggtttattggttagtagtcgatctaattgtttgaagaaacctccgaccgtgtataaagcttccttctagtgaactgtatttaagtcaggaagttttctattgtatattgcagattaattgaatggctcaggaattccctagttgatttttaagtgttttaccgtctgaataataatattttacaatcagatttcgatattgtattt

SEQ ID NO: 608 - DNA, 1519 bp, Oryza sativa
gaacaacggaaaacacacacaaaaaggggaagaaaatcacgcaaagaaagggaaaaaaaataactcgaagagtccgttttttcttcctcctactcgccccaatccaatccactccaccgtaccactcgccgccgccgccgccgccgacgacgaagccggcgccgccgccggagccgatcccccgcgggcccaccctcctacttcgcgcttcctcggccgaaatccctaccgggtcgaatcgccccgcggcgcgccgctgatccgcgccgccgcgccctagccatcccggggacgggcggcggctgctgctgctgctgccgatgcatggttggtggtggcgggtaggtgagtaagagagtaggcgtaccatgttgcagtgtctggagggggtgaagcagctctgcggcgtgctactcaagtgctgcgacctcgacctcaagcagcccaaggggctcgaggatcccgaaatcctcgccagggagaccgtctttagtgtgagcgaggttgaggcgttgtatgagctgttcaagaagatcagcagcgcggtgatcgatgacggactgatcaacaaggaggagtttcagttggcgctgttcaagaccaacaagaaggagagtttatttgctgaccgtgtatttgatttgttcgatacaaaacacaatggtattttaggattcgaagaatttgcccgtgcgctctcagtatttcatccaaatgcacctctcgacgagaaaattgacttttctttccagctatatgacctcaagcaacaagggttcattgaaagacaagaggttaagcaaatggttgttgcaacacttgctgagtcgggaatgaatctttcggatgaagtcatagagagcatcattgataagacatttgaggaggccgacacaaaacatgatgggaaaattgataaagaagaatggcgcaatctagttctcagacatccttctttactgaaaaacatgacactccaatatctcaaggacatcacaactacatttccaagctttgtcttccattctcaagtcgacgatacttgaaatctgagaatttccccctccaatggaatgccagaagacagtctcgttgcttttgaggctttgcaatgagtagtttttggttcagcacttcatctgaagccataaagttccagagatgatcacatattgcagtggagaaatcaaacatttccgtattgttaataatagttctttttcttgcttttagccggtgtgtgatatctgtctcaagtttcttttccctattttctgtttttttttctttctgttggtttattggttagtagtcgatctaattgtttgaagaaacctccgaccgtgtataaagcttccttctagtgaactgtatttaagtcaggaagttttctattgtatattgcagattaattgaatggctcaggaattccctagttgatttttaagtgttttaccgtctgaataataatattttacaatcagatttcgatattgtattttttttggtactcagcccc

SEQ ID NO: 609 - DNA, 1253 bp, Oryza sativa
acaacgacatcctctcctcatcgccttctagaaacatcccacgacgagcctctcctctgatcctctcctcccccactccaccgccaccgccgccgtcgccgctgccgccgccgccgcgcgaggaggacgggcggatctcccaatgaggtgtgaggcttgttgattggggagctgctggttgtagtttgcaattgcaaatggtggattcctcggaagggctccgacggctcgccgcgttgctgttcaagtgctgcagccttgacagctccaatcgtcccaacggcctgcaggatcctgaacggttggcgagggaaacagtttttaacgtaaatgaaatagaggcgctgtatgagctgttcaagaagattagcagtgctgtggttgatgatggcttgatcaataaggaagaattccaactggcactgtttaagaccaacagaaaagacagcatgtttgctgatcgggtatttgatttgtttgacacgaagcacaatgggattcttggattcgaagaatttgcacgggctctttctgtgtttcatcccaatgctccaattgatgacaaaattgattttgctttcaaactttatgatctcaaacaacaaggtttcattgagaagcaagaggtgaagcaaatggtggtcgccacacttgctgaatcaggaatgaacctttcagatgagattatagaaggcattattgacaagacatttgaggaagcagatacaaagcatgatgggaaaattgacaaggaggagtggcgcaaccttgtgttgaggcatccatctttattaaagaatatgacactcccatatctcagggatataactacaacatttccaagttttgtattcaactcccaggttgaggacgcatgaggtcaagcttcagaccatattctagggtccagttcgttttatttcattttgttgatatctttctcgtgcttggaacaaacttttatgattgctccgcttcaagatgtgaatccgtagcaaggatgaagtttttaccattttttatgtatatacttgaagatggccttcaactcttcatgtgtagacttgtaggatgaaccgtttctcgtgatgtagaaatgttcttcaatcctaagataaacggttgcctctaccgtcagcaactctcgttaccgagtatgcaaacctaggtcctcttctacccaagaatccgggatgccactatttgatcgagcccagcaaggcgaacactcgagcagtgaagctgttatttga

SEQ ID NO: 610 - DNA, 1217 bp, Oryza sativa
ccttggacctgactggactgaaggagtagaaaaacacaacgacatcctctcctcatcgccttctagaaacatcccacgacgagcctctcctctgatcctctcctcccccactccaccgccaccgccgccgtcgccgctgccgccgccgccgcgcgaggaggacgggcggatctcccaatgaggtgtgaggcttgttgattggggagctgctggttgtagtttgcaattgcaaatggtggattcctcggaagggctccgacggctcgccgcgttgctgttcaagtgctgcagccttgacagctccaatcgtcccaacggcctgcaggatcctgaacggttggcgagggaaacagtttttaacgtaaatgaaatagaggcgctgtatgagctgttcaagaagattagcagtgctgtggttgatgatggcttgatcaataaggaagaattccaactggcactgtttaagaccaacagaaaagacagcatgtttgctgatcgggtatttgatttgtttgacacgaagcacaatgggattcttggattcgaagaatttgcacgggctctttctgtgtttcatcccaatgctccaattgatgacaaaattgattttgctttcaaactttatgatctcaaacaacaaggtttcattgagaagcaagaggtgaagcaaatggtggtcgccacacttgctgaatcaggaatgaacctttcagatgagattatagaaggcattattgacaagacatttgaggaagcagatacaaagcatgatgggaaaattgacaaggaggagtggcgcaaccttgtgttgaggcatccatctttattaaagaatatgacactcccatatctcagggatataactacaacatttccaagttttgtattcaactcccaggttgaggacgcatgaggtcaagcttcagaccatattctagggtccagttcgttttatttcattttgttgatatctttctcgtgcttggaacaaacttttatgattgctccgcttcaagatgtgaatccgtagcaaggatgaagtttttaccattttttatgtatatacttgaagatggccttcaactcttcatgtgtagacttgtaggatgaaccgtttctcgtgatgtagaaatgttcttcaatcctaagataaacggttgcctctaccgtcagcaactctcgttaccgagtatgcaaacctaggtcctcttctaccc

SEQ ID NO: 611 - DNA, 1371 bp, Sorghum bicolor
tggacgacaccgacggcgaagagaggaagaacgcagcgccgagccgaaccccgcaaccgcaacccaccacttccccgtcgcgatttgcattgccctccgcctcgggcaggccccgatcccgccgcgccctaccccaagccccccgcgccgccgccgggccggagagatcgcgcccccccattcccacaatcccatccctccgtccctcgaggagccggccgccgagccctccgcgcggccgtgggatggggcggtgacagcaccagtgagtggcgtggggggcggcgggtgcgggagccggtggcggcgagcgcatatcatggtgcagtgcctggacggggtgaggcagctgctcgcggtcctgctcaagtgctgcgacgtcgacctcaagcagccgcgggggctcgaggatccccaggtcctcgcgagggagaccgtcttcagcgtcagcgaggtcgaggcgctctatgagctgttcaagaagatcagcagcgccgtcatcgatgatgggctgattaacaaggaggagtttcagttggcgctatttaagaccagcaagaaggagagcctgttcgcggatcgtgtatttgatttgtttgacacaaaacaccaatggaattttaggatttgaagaatttgctcgtgctctctcagtatttcatcctaatgctcccgttgatgaaaaaattgacttttcattccggctgcatgatctcaagcagcaaggctacattgagagacaagaggttaagcagatggttgttgcgacacttgctgagtcagggatgaatctttcagatgaaattgtagagagtataattgacaagacatttgaggaggcagacacaaagcatgacggaagaattgacaaggaagagtggcgcagtctagtcattcggcatccatctctgctcaagaacatgactcttcagtacctcaaggacattaccactacatttccaagctttgtctttcactctcaagtcgatgataactgagattcatgggattattttgacaagaaacatcagaagatatgctcgtgggtttctgatatggttttcattttttaatattgggttgttggattggccgagattgtagtgctccgaagtatgttgcatactggattcgagaactcgaatctttttttcaaccttttttctttcatttgcatgtctggatgcgcttggaaaagatatgtagtatatgcccaatgttcccctttttggatcttttggctggcccgcaatcggatccagttcttagaatcttctgtcttctgtacaggaatggaaacagcggtttaaggatttgtattgtgcttggacttcttttaagtagtggctcgagcagaaatatttttggttg

SEQ ID NO: 612 - DNA, 1325 bp, Sorghum bicolor
gaaccgcaacccaccacttccccgtcgcgatttgcattgccctccgcctcgggcaggccccgatcccgccgcgccctaccccaagccccccgcgccgccgccgccgccaccgccggagagatcgcgcccccccattcccacaatcccatccctccgtccctcgaggagccggccgccgagccctccgcgcggccgtgggatggggcggtgacagcaccagtgagtggcgtggggggcggcgggtgcgggagccggtggcggcgagcgcatatcatggtgcagtgcctggacggggtgaggcagctgctcgcggtcctgctcaagtgctgcgacgtcgacctcaagcagccgcgggggctcgaggatccccaggtcctcgcgagggagaccgtcttcagcgtcagcgaggtcgaggcgctctatgagctgttcaagaagatcagcagcgccgtcatcgatgatgggctgattaacaaggaggagtttcagttggcgctatttaagaccagcaagaaggagagcctgttcgcggatcgtgtatttgatttgtttgacacaaaacaccaatggaattttaggatttgaagaatttgctcgtgctctctcagtatttcatcctaatgctcccgttgatgaaaaaattgacttttcattccggctgcatgatctcaagcagcaaggctacattgagagacaagaggttaagcagatggttgttgcgacacttgctgagtcagggatgaatctttcagatgaaattgtagagagtataattgacaagacatttgaggaggcagacacaaagcatgacggaagaattgacaaggaagagtggcgcagtctagtcattcggcatccatctctgctcaagaacatgactcttcagtacctcaaggacattaccactacatttccaagctttgtctttcactctcaagtcgatgataactgagattcatgggattattttgacaagaaacatcagaagatatgctcgtgggtttctgatatggttttcattttttaatattgggttgttggattggccgagattgtagtgctccgaagtatgttgcatactggattcgagaactcgaatctttttttcaaccttttttctttcatttgcatgtctggatgcgcttggaaaagatatgtagtatatgcccaatgttccccttttttgatcttttggctggcccgcaatcggatccagttcttagaatcttctgtcttctgtacaggaatggaaacagcggtttaaggatttgtattgtgcttggacttcttttaagtagtggctcgagcagaaatatttttggttg

SEQ ID NO: 613 - DNA, 1182 bp, Sorghum bicolor
gctgacgtggcgctcctcctcctgctcctcctccgccggcgattcgctcccgtccctcctctcgcggccacgccctccccggcgcctccgcaacctctcaccgccggcccccgcccgccctccgtcccccctccacgcctcgaacagcccgcctccatccgcgaggaggaaccccgatgagctcggagacgtgttgatttggatagctattcgtagagtgtgcaatggtggacttcgttcgacggcttgcctctgtcctgctcaagtgctgcgatctcgacatacccagtcggccaaagggccttgaggaccctgaacgcttggctagagagactgtttttaatgtgaatgaaatcgaggctctgtatgagctgttcaagaagattagcagcgctgtggttgatgatggcttgattaacaaggaagaattccaattagctctgtttaagaccaacagaaaggatagcatgtttgctgatcgggtatttgacttgtttgacacgaagcacaatggaattcttgaatttgaggaatttgctcgagccctttctgtgttccatccaagtgcaccaattgatgacaaaattgattttgctttcaaactgtatgatctcaaacaacaaggtttcattgaaaagcaggaggtcaagcaaatggtggtcgcaacacttgctgaatcaggaatgaatctttcagatgatattatcgaaggcattattgataagacatttgaggaagcggatacaaagcacgacgggaaaatcgacaaggaggaatggcgtagccttgtcttgaggcatccatctttgttaaaaaatatgaccctcccatatctccgggatatcaccacaacatttccaagctttgtgttcaactcgcaagtagaggatgcgtgaggtcccagcgtctaaggcaccactcaagcccctggggcacagcagttcatgttctgtaggggcactagtgtgtttttgtttccttgaaaatgtaaattttatgtgctggcacgtcctccttttgtatagtgagtattgctattgtgcacagaattgcagcatgaagcgtttcttgtcatgtgtttataaaatgttcttcaaacatattgttcatcaaaagctaaagtaagatttgaaccgagtctaaaactactcaaagtcaattgaattgagtacaaatgatccc

SEQ ID NO: 614 - DNA, 1604 bp, Glycine max
ctctttcattctaatattctttccataaatataataattaattcagtcagttttgttattttgggttacaagattgttcaattttgcacctcacctgcttttaaatcaaatccccccaattatatataaaaccaaaaacccacccaccttgatgcatgcttgcgttgcttgttcctatattacaattacaattttcaaagacaaacatgtccgagaatattgactccaactctccttcgctttccctctttctctgaaaggtatggagtgctttgacttctggaagagataatggtgcagtgcctagacggattaaagcatttgtgtgctgctctgataaattgttgtgatgctgattcgtcaaagcaacctacaggtttagaaaatcctgaagttcttgcaagagagaccgtgtttagtgtaagtgagattgaagcactgtatgaattgttcaagaagatcagcagtgcagtgattgatgacggactaattaataaggaagaatttcagttggcattgttcaagacgaacaagaaagagagcttatttgcagatagggtgtttgacttgtttgatacaaagcacaatgggatacttgattttgaagagtttgcacgtgctctctctgtctttcatcccaatgcaccaattgatgataagattgagttttcattccaattgtatgatctcaaacagcaaggttttattgaaaggcaggaggtaaaacaaatggtagtggccactctagccgaatctggcatgaatctttcagatgatgtgatcgaaagtattattgacaagacatttgaggaagctgataccaaacatgatgggaagattgacaaggaagaatggcgaaaccttgtcttgcggcatccatcccttctgaaaaatatgactcttcaatatctcaaagatatcaccactacatttcccagttttgtttttcactcacaagttgatgatacttgaggcaaactacagcatccatgtcagtttcagtgttcttgactgggaatggtcttcgattgacttgtgaatgatgaccgggttctatgtgaaggattcggtacggggtggatatggagtttatttatattttcattacaagtagaactttgtcttcccgtttttggatggatgaggtttgtagattgaacaaatgggtttgattatttatttatttgcttcatttgagaataaaagggggaacaaaatagaatattcaggcatttcagcattagcactttggaattaattttggtgagaaatatgtttaccataagtcttgtgcaattgcttcagcaatctgtgaagagttctttgagcacatgccctgggttgagaattgctgctccaaaaaacttaagtgcatgtcagttgttgtgcttaaagccaactctagctttcctccttgacagaaagataatgcccctctctatccaatttatttcactcttatatttgccattatttttgtctaggccattggcgattaaaaattaatttgcagcctatgttttcttgtaattacattttttttttgcaagtgtatgtatttgagaaattaattgaaaaacattattttatgagtgccaaaaaaa

SEQ ID NO: 615 - DNA, 1542 bp, Glycine max
ctctttcattctaatattctttccataaatataataattaattcagtcagttttgttattttgggttacaagattgttcaattttgcacctcacctgcttttaaatcaaatccccccaattatatataaaaccaaaaacccacccaccttgatgcatgcttgcgttgcttgttcctatattacaattacaattttcaaagacaaacatgtccgagaatattgactccaactctccttcgctttccctctttctctgaaaggtatggagtgctttgacttctggaagagataatggtgcagtgcctagacggattaaagcatttgtgtgctgctctgataaattgttgtgatgctgattcgtcaaagcaacctacaggtttagaaaatcctgaagttcttgcaagagagaccgtgtttagtgtaagtgagattgaagcactgtatgaattgttcaagaagatcagcagtgcagtgattgatgacggactaattaataaggaagaatttcagttggcattgttcaagacgaacaagaaagagagcttatttgcagatagggtgtttgacttgtttgatacaaagcacaacgggatacttgattttgaagagtttgcacgagctctctctgtctttcatcccaatgcaccaattgatgataagattgagttttcattccaattgtatgatctcaaacagcaaggttttattgaaaggcaggaggtaaaacaaatggtagtggccactctagccgaatctggcatgaatctttcagatgatgtgatcgaaagtattattgacaagacatttgaggaagctgataccaaacatgatgggaagattgacaaggaagaatggcgaaaccttgtcttgcggcatccatcccttctgaaaaatatgactcttcaatatctcaaagatatcaccactacatttcccagttttgtttttcactcacaagttgatgatacttgaggcaaactacagcatccatgtcagtttcagtgttcttgactgggaatggtcttcgattgacttgtgaatgatgaccgggttctatgtgaaggattcggtacggggtggatatggagtttatttatattttcattacaagtagaactttgtcttcccgtttttggatggatgaggtttgtagattgaacaaatgggtttgattatttatttatttgcttcatttgagaataaaagggggaacaaaatagaatattcaggcatttcagcattagcactttggaattaattttggtgagaaatatgtttaccataagtcttgtgcaattgcttcagcaatctgtgaagagttctttgagcacatgccctgggttgagaattgctgctccaaaaaacttaagtgcatgtcagttgttgtgcttaaagccaactctagctttcctccttgacagaaagataatgcccctctctatccaatttatttcactcttatatttgccattatttttggctaggctattgatgattaaaaatcaattagcagcgtatgttttctgtaattacattttttgc

SEQ ID NO: 616 - DNA, 1231 bp, Glycine max
gtcatcgaccatatcactttggtcaccataagatacattcgtcgcattcatccatttaacttccacaaattcctacaaattctaaccaaacccttcactactccaaatcccacaacttctctcttttttttccctccttcttttccctttttctgttgtccgatcttctgcctcctagatcttggtatttgggattgatcacctggagttggaaatggttaaaagttatggagtgttctgatttgcaaaagatatcatgttgcggtgcttagagggacttaagcctttatttgcttccatattacgatgttgtgacctggatatatataaccagccaagaggccttgaagatcctgaacttcttgctagagagactgtgttcagtgtaagcgaaatagaagcactctacgagctcttcaaaaagattagcagtgctgtaatcgacgatgggttgattaacaaggaagagtttcagttggcattgttcaagacaaataaaaaagaaagtctgtttgctgatcgggtatttgatttatttgacacaaagcacaatgggatactaggttttgaagagtttgctcgtgctctctccgtttttcatccaaatgcccctattgatgataagatcgaattttcctttcaactatatgatctcaagcagcagggttttattgaaagacaagaggtgaagcaaatggtagttgctactcttgctgaatctggcatgaacctatcagatgacgttatagaaagtataattgacaagaccttcgaggaagcagatacaaagcatgatggcaaaattgacaaggaagagtggagaaaccttgttttgcgccatccgtcacttttgaagaacatgacccttcaatacctcaaggacatcaccacaacattcccgagctttgtatttcattcacaagtagacgatacttgaagataatttctcccatggcttcttcctttgggctgcatggccacttttgtacaaaaaagggcatggcagacagccttgcttttaccttacatttgttatatctttgaataatgtattttgttttgtggattcttttgctgggattttactttcattttttcttcaaacttctagacacatttggttcccatttttcaaatttcaaaagcaagattccaaggttgtgtagagtttgttttaaattatgagtatgtcatgacctcagaatattttgaaattctttatggtcaaaac

SEQ ID NO: 617 - DNA, 2771 bp, Glycine max
  misc_feature (2544)..(2544): n is a, c, g, or t
ctaaagcccccattgatgaaaagaacaatttttcctttcaactatatgatctcaagccgcagggttttattgaaaggcaagaggtgaagcaaatggtagttgctacccttgctgaatttggcatgaacctatcagatgatgttatagaaagtataattgccaagcccttcgaggaagcagatccaaagcatgatggcaagattgccaaggaagagtggagaaaccttgttttgccccatccgtcccttttgaagaacatgccccttcaatatttcaaggggttgtactctatctgtcatcgaccatatcactcaccttcagatacattcgtcgcattcatccatttaactattaaatgactcattcaccatatgtcatggctcatattcctttagacatcgaccatatcactttsgtcaccttcacagatacattcgttgcaatcatccatctcacttccacaaattcctccaaattctaaccaaacccttcactactccaaattccaaaacttcttcacactccttcttttccctcttctgttgcccgatcttctgcctcctagatcgatggttttttttcgtgcatgtgaatagtgaattgtcctgaattcagaatctgatcacttaccaaatttgaaaagccgtgttcttttgatgtggggatgttgaaatttgaatctggtgttgttctgaggcgattttgatgggttttgtatgtgaggatggatgtgggatcatggatccgagtttatcaattatcagtaattgtggtatcaagattttggtatttgggattgatcacctggagttggaaatggttaaaagttatggagtgttctgatttgcaaaagatatcatgttgcggtgcttagagggacttaagcctttatttgcttccatattacgatgttgtgacctggatatatataaccagccaagaggccttgaagatcctgaacttcttgctagagagactgtgttcagtgtaagcgaaatagaagcactttacgagctcttcaaaaagattagcagtgctgtaatcgacgatgggttgattaacaaggaagagtttcagttggcattgttcaagacaaataaaaaagaaagtctgtttgctgatcgggtatttgatttatttgacacaaagcacaatgggatactaggttttgaagagtttgctcgtgctctctccgtttttcatccaaatgcccctattgatgataagatcgaattttcctttcaactatatgatctcaagcagcagggttttattgaaagacaagaggtgaagcaaatggtagttgctactcttgctgaatctggcatgaacctatcagatgacgttatagaaagtataattgacaagaccttcgaggaagcagatacaaagcatgatggcaaaattgacaaggaagagtggagaaaccttgttttgcgccatccgtcacttttgaagaacatgacccttcaatacctcaaggacatcaccacaacattcccgagctttgtatttcattcacaagtagacgatacttgaagataatttctcccatggcttcttcctttgggctgcatggccacttttgtacaaaaaagggcatggcagacagccttgcttttaccttacatttgttatatctttgaataatgtattttgttttgtggattcttttgctgggattttactttcattttttcttcaaacttctagacacatttggttcccatttttcaaatttcaaaagcaagattccaaggttgtgtagagtttgttttaaattatgagtatgtcatgacctcagaatattttgaaattctttatatttatgcaagcactagccctgattttgtgccaaaaactgttgatatagcagccaaagaactaatagcaattgcttcccctggacaagttacacaggtacagcttgaccgagccaaaaaatccacaaagtctgcagttctaatgaatctggaatctagaatgattgcatcagaagatatagggaggcagattttgacttatggagaaaggaagcctgtggaacagttcttgaaggctgtagatgaaatcacgttgaatgatatcactaaaattgctcaaaagattatttcctcacctttgacgatggcatcatatggggatgtcatgaatgtgccaagttatgaatctgttaacagcaagttccatgcaaaatgaaattgcatgtgatccaccttcggctcatcatattttctggatcacaagcatgcctacttccaattttcaagagcaatatacaccgaatcagcaatgctgaaaataaatcccagagaatttttttgtgcggatctgaggaaccattgttcttgttccatgtttgttttttttttttatataacgatttgccttactgtattaggtgcatggtctcatgactaatgctcacctcaattttttatttatgaattaattctcaagagagcacgaaagccaagccacgcatgaatagatcaagaaaaatgcaagtaatatactcatcaatcaaatataattttctaacanaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaaaaaaaaaaagggggccgttttaaaggacccaatttaacttccccgggctggcaaggtaaaattttttttttggggcccccaaattcaaattcagggcccggggtttaacaacgtggggacgggaaaa

SEQ ID NO: 618 - DNA, 1370 bp, Saccharum officinarum
  misc_feature (3)..(3): n is a, c, g, or t
  misc_feature (10)..(10): n is a, c, g, or t
  misc_feature (13)..(13): n is a, c, g, or t
  misc_feature (15)..(15): n is a, c, g, or t
ccnacgcgtncgnanacacgacgacctccaccgtttcatcctcttccccaaatccgtccgacgacctttcctccggcggccggccacaacgagcctcgggcaccgcacagcaaatcctacccgtcgaatcgtgcgtctcgccgagcctcgatccgatccccgccacgccgatcccgcgtcggtcgtccgaatccggtggattatctccgccgccgggcgttcatttgggcccgggggagccggggggtgggggtgggtatttggtgccgtgagttgctgctcccgcccgtcgatgcttggttagcagaggaggcggcggtaccatgttgcagtgcctggatggagtgaagcacctacttggcgtgctcctcaagtgctgcgacatcgacctcaagcagcccaaggggctagaggatccggaggtgctcgctagggagaccgtgtttagcgtgagcgaggttgaggcgttgtatgagctgttcaagaagatcagcagtgccgttattgatgatggactgatcaacaaggaggagtttcagttggcgttgttcaagactagtaagaaggagagtttgtttgctgatcgtgtatttgacttgtttgatacaaaacacaatggaattcttggatttgaagaatttgcccgggcactctcagtatttcatcccaatgctcccctagatgagaagattgagttttcattccaactatatgacctcaagcaacaaggcttcattgaaagacaggaggtaaagcaaatggttgttgctacacttgcagagtcaggaatgaatctttcagatgaggtcatagagagcatcattgataagacttttgaggaggcagacacaaagcatgatgggaaaattgacaaagaagaatggcgcaatttagtagtgaggcatccctctttattgaagaacatgacactacaatatctcaaggacatcaccacaacatttccgagctttgtcttccattctcaggtcgatgatacctgaacttctgaaaactaatgaatatcagaaggtggactgcttgctttgctaaacaaacttttcagtgcttatttgatggttcagcagatcccagcgtcctgaaggcatcaaaccattcatgttgttaataacttttttcttgttttttttttaattttgaattcttgttgaattctgtgtgaattccccttctctttttttcctccattgttcttttattctatttcggtttggatggccagtagcgatcgagtcagttgatgtgtgtacaaagctgcagctgatgctgcctatcagtgaattgtatgttatgcgaggaagatttcaattgtatatgcaacttctgtggcgacaatagttgcacatatttcc

SEQ ID NO: 619 - DNA, 889 bp, Helianthus annuus
atcacttaccatctttcttcatttcttttcccttttttaaatctggaattttgattgtgttctcactccaaatctatacatccaataccacccataccatacccatctaccaatctttcctttcacagaaatagtttgatcagagcctttttatttcagcagcaacwkkrawygkccaaaargtatggaaggttttgatgtacgacgagtgccatgtctcagtgcttagaagggatcaagcatttatgtgcttccctgctttactgctgcgattttgaattgagtaaacagtcgcaggggcttgatgatcccgcagttcttgctagccagacagtttttagtgtaagtgaaatcgaagcgctttacgagctgtttaagaagataagtagtagtgcagtcaacgatgacgggttaatcaataaagaaaagtttcagttggcattgtttaagaccaataaaaaggagagcttgtttgctgatcgggtgtttgacttgtttgacacaaagcataatggaatcttgggatttgaagagtttgctcgtgcactctcggtgtttcatccgaatgcccctattgatgataagatcaacttttcctttcagctttatgatcttaagcagcaaggatacatagagagacaagaggtgaaacagatggtggtggctacgcttgccgaatcagggatgaacctgtcagacgaggttatagagagcatcatcgacaagacttttgaagaagcagacacgaaacacgacgggaaaatcgatcaagaagagtggaggaaccttgtcctgagacacccttctcttttgaagaacatgacattgcaatacctaaaggacatcacgacgacatttcccagctttgtttttcactcgagggtcgagg

SEQ ID NO: 620 - DNA, 1084 bp, Helianthus annuus
  misc_feature (1016)..(1016): n is a, c, g, or t
cgcggggattttttgatcttcgagtcgatattcgtcagtaaatccacaaaatccgctaggttttctctatttcagcacacatccgattgtttttcgcaagttataaattgattgctccttctcatcaagtgatttataaagtttaaattaaatcagcaataggaaatggtcaaaaggagcaagtatggatcattttaatgtgcaacaggtaccatgtctcagtgtttagagggggtcagacacttatttgcttccctgctacactgctgtgatcttgagctgtataaacaatcaagaggccttgaagatcctgaaattctagccagagagacagtgtttagtgtaagtgaaattgaggcactttatgagttatttaagaagataagcagtgcagtcattgatgatgggctaattaataaggaggagttccagctggcattgtttaagacgaataaaaaagaaagcttgtttgccgatcgggtgtttgacctgtttgacacgaagcataatggaatcctgggtttcgaggagttcgctcgtgcactctcagtatttcatcctaatgcccctgttgatgataaaattgaattttcctttcagctttatgacctcaagcagcaaggtttcatagagaggcaagaggtaaagcaaatggtggtagctacccttgctgagtcaggcatgaatctttcagatgatgtcatcgaaagcatcatcgacaagacatttgaggaagccgatacaaaacatgatgggaagatcgacaaagaagaatggaggagtcttgtactgcgacatccatcccttttaaaaaatatgacgcttcagtatctcaaggatatcacgacaacgtttccaagcttcgtttttcactcgagagtagaggatacgtaaccgattgagaacgtagtcggagatttgtgtgtttttattgtggttttgttctcacaagcagaggtgagtttgtggataaacttttggtttttgaatgatttgattgtgacgccattctatcnaagtatattatgtttataagacacctttattattagactatgattattgaataagaattattgttggc

SEQ ID NO: 621 - DNA, 892 bp, Nicotiana sp.
tcggtgtcaagaaaaaaattgacgactgggcaaagaggagcggcccatatttacatcggtcaccgtcagattcatcttatttagtcgtttctccttgtttatcttattcatctgaatctctgcgctcttctctcttaagatatatagctccaaattgatcattttcagaaactcgcaacatattacattcagataggacgataacagagaatggtcaaaggatatggagcaaattgaagtagggatcataccatgttgcagtgcctagacggtatcaagcatttaggtgcttctctgtcgaaatgttgtgatctggataggcaatcaacgggctttgaagatccggagatcctagcacgagaaacagtttttagtgtcagtgagattgaagctctttatgagctatttaagaagatcagcagcgcagtggttgatgatgggctgatcaacaaggaagaatttcaattggcactattcaagacgatcaaaaaggaaagcttgtttgccgacagggtctttgacttatttgacacaaagcacaatggaatcttggggtttgaggaatttgctcgtgccctctctgttttccatccaaatgctcctattgatgataagattgagttttcttttcagctatacgatctcaagcaacaaggcttcattgagaggcaagaggtgaagcaaatggtggttcctacccttgctgagtctggtacgaacctatcagatgaggtcattgagagcataattgataagacttttgaagaagccgatactaaacatgacggaaagattgataaggaggaatggagaagtttggtcttgcaacatccttcacttttgaagaatatgactctccaatatctcaaggacattacgactacattcccga

SEQ ID NO: 622 - DNA, 1274 bp, Nicotiana sp.
ggccattacggccggggaacagcaaccagaaattacagttatagaagataaagaagaagccccatcaacttcattctatctgtcgaacgtatcttcaatctgaatttcatcaaatttctgtctaaattcaaaagggtgtatagctccaaagttcaagaacttttggcgttttgcattcacatagtcaaaaatagcaaagaatggtcacgagctatggcgagctctgaagtcaggggaataccatgtcgcattgtttagaggggatcaagcatttaggtgcttccctgytgcastgttgtgataggcaatcmacgggccttgaagatcccgagattcttgcacgagagacagtttttagcgtcagtgagatcgaagctctttatgagctttttgtgaagattagcagcgcagtrattgatgatggkctgatcaacaaggaagagtttcaattggygctattcaagacaagcaaaaaagagagcttgtttgctgayagggtgtttgacttgttygacacaaagcacaatggactcttgggttttgaggagtttgcccgtgcrctctctgttttccatccraatgctcctatcgaygataagattgggttttcttttcagctatatgatctcaaacaacaaggcttcatcgagaggcaagaggtgaagcaaatggtggttgctacccttgctgagactggtatgaacctttcagatgaaattattgagagcataatcgacaagacktttgaagaagctgatactaaacatgacggaaagattgataaggaagagtggagaaatttggtcctgcgacatccttcacttctgaagaatatgacccttcagtatcttaaggacattacgactacattcccgagttttgtctttcactcaagagtcccggatacctgatatggaattggcaaacggacttgcttacggaagtagttttgttacttgagtgctgcagctcaaggtgaaagtatataactagtcttgctcatctattctgagttccaacattttcatgatttgttattcattctgagagtagtgcttgtgtatttttgttgccacttaataaatgttgaatatgtatcctygtaaktttcwmwttgctcmttattaattkryttgmttratgtgtatttcaattcagacatcttaatcttaatacagattagtactgcgatagaatccaaaaaaaaaacacacaaaccaacaaaaagcgccgcaacgggtggactcaattgcctatatgatcgattacgcgct

SEQ ID NO: 623 - DNA, 1107 bp, Nicotiana sp.
tcggtgtcaagaaaaaaattgacgactgggcaaagaggagcggcccatatttacatcggtcaccgtcagattcatcttatttagtcgtttctccttgtttatcttattcatctgaatctctgcgctcttctctcttaagatatatagctccaaattgatcattttcagaaactcgcaacatattacattcagataggacgataacagagaatggtcaaaggatatggagcaaattgaagtagggatcataccatgttgcagtgcctagacggtatcaagcatttaggtgcttctctgtcgaaatgttgtgatctggataggcaatcaacgggctttgaagatcctgagatccttgcacgagagacagtttttagcgtcagtgagattgaagctctttaygagctctttaagaagattagcagtgcagtaattgatgatggtctaatcaacaaggaagagtttcaattggcrctattcaagacaaataaaaaagaaagcttgtttgctgacagggtgtttgacttgtttgacacaaagcacaatggaatcttgggttttgaggaatttgctcgtgcgctctctgttttccatccaaatgcacctattgatgataagattgagttttcttttcagctatatgatctcaagcaacaaggtttcattgagagacaagaggtgaagcaaatggtygttgctactcttgctgagtctggtatgaacctttcagatgatgtaatagagagcataattgacaagacttttgaagaagctgatactaagcatgacggaaagattgataaggaggaatggagaaatttagtcttgcgacatccttcacttttgaagaatatgaccctccaatatctcaaggacattacaacaacatttccgagctttgtctttcattcaagagttgaggacacctgatttgggcytgagaaggagagttgtttaccgaagtagtatattgctttttcttttgtttcattgggaactgcagttggccggctatatgggtatatgacattgttttgctctttcatttttctccattttaaaattcgacattttcaggatttcttattctttttgagtagtgcttttgcg

SEQ ID NO: 624 - DNA, 1079 bp, Solanum lycopersicum
aaaaccaaaaagaaataaataaggttaaggagagcttcctccttctcctacctcaaaaattcatctctgattttgcaatcatctcaaattaaatctccatttattcataaacatatatagctgcatatagataggtttcagaaactttcagtattttggattcataaatagacataacagagaatggtcgaaagatatggagtgttttgaatctgagacgttaccatgctgcagtgcttaggttcttacctttcgaggtgttgcgatcttgattttaagcaatcggggggcctcgacgatcctgagatacttgcacgagagacagtttttagcgtcagcgagattgaagctctttatgagctctttaagaagataagcagtgcagtgattgatgatggtttaatcaacaaggaagagtttcaattggcacttttcaagacaaataaaaaggaaagcttgtttgctgaccgggtgtttgacttgtttgatacaaaacacaacggaatcttgggatttgaagaatttgctcgtgcactctctgttttccatccaaacgcacctatcgatgacaagattgaattttcttttcagctatatgatctcaagcaacaaggttttattgagagacaagaggtaaagcaaatggtagtggctactcttgcggagtctggtatgaacctctctgatgatgtgatcgagagcattattgacaagacttttgmmgmmsccgatacsaagcatgayggaaagatygataaggaggaatggagaaacttagtgttgcgacatccttcmcttttgaagaacatgmccctccaatatctcaaggmcattactacaacgtttccgagctttgtctttcattcaagagttgaggmcmcctaatytgggatttgacaagaggagttgcttgcaaaagtaacatattatgattccmygmmcatagtatamcattctgtttgctctctacatggkttcttawwattcttttttgaatagttgtcttgtgatttatttcaatgaattgatgtggagtttctattgcctgaaaggacccaaacaaaacccctcctcttcgt

SEQ ID NO: 625 - DNA, 1072 bp, Solanum lycopersicum
  misc_feature (1066)..(1066): n is a, c, g, or t
ggaggagtggcccatatttttgcatttgctcacaccgtctcaattcatcattatttttagtcgcttctcctttgtctcctccattgttcatcatctcctctcttcagacaaatagcttgaaattgatcatcttcagaaacttttagcaatttatattcactaaggacgataacagagaatggtcaaaagatatggagcgttttgaagcaggaattataccatgttgcagtgcctagaggggatcaagcatttaggtgcctctctgtctaaatgttgtgatctggacagacaatcaacagcctttgaagatccagagatccttgcacgggagacagtttttagcgtcagtgagattgaagctctctatgagctttttaagaagattagcagtgcagtggttgatgatgggctgatcaacaaggaagaatttcaattggcgctattcaagacgaacaaaaaggaaagtctgtttgcagatagggtatttgacttatttgacacaaagcacaatggaatcttgggttttgaggagtttgctcgtgccctctctgttttccatccaaatgctccgatcgatgataagattgagttttcttttcagctatacgatctcaagcaacaaggcttcattgagaggcaagaggtgaagcaaatggtggttgctacccttgctgaatctggtatgaatctgtcagacgatgttattgagagcataatcgataagacttttgaagaagctgatactaaacatgatggaaagattgacaaggaggaatggagaaatttggtcttgcaacatccttcacttttgaagaacatgacccttcagtatytcaaggacattacgactacattcccaagctttgtctttcattcgagagttgaggattcctgatttggcatatacaagctggagttgtttagggacctccctttaccatctttgtttcctgttatgtttttggaaaaactagtcagtttatggatatggatgtctggatacctgtttgttgctgccctgtttcaaaatttgactattaaagggatttgttattcatttcgagtntagtgg

SEQ ID NO: 626 - DNA, 957 bp, Solanum lycopersicum
gaaataaataaggttaaggagagcttcctccttctcctacctcaaaaattcatctctgattttgcaatcatctcaaattaaatctccatttattcataaacatatatagctgcatatagataggtttcagaaactttcagtattttggattcataaatagacataacagagaatggtcgaaagatatggagtgttttgaatctgagacgttaccatgctgcagtgcttaggttcttacctttcgaggtgttgcgatcttgattttaagcaatcggggggcctcgacgatcctgagatacttgcacgagagacagtttttagcgtcagcgagattgaagctctttatgagctctttaagaagataagcagtgcagtgattgatgatggtttaatcaacaaggaagagtttcaattggcacttttcaagacaaataaaaaggaaagcttgtttgctgaccgggtgtttgacttgtttgatacaaaacacaacggaatcttgggatttgaagaatttgctcgtgcactctctgttttccatccaaacgcacctatcgatgacaagattgaattttcttttcagctatatgatctcaagcaacaaggttttattgagagacaagaggtaaagcaaatggtagtggctactcttgcggagtctggtatgaacctctctgatgatgtgatcgagagcattattgacaagacttttgaagaagccgataccaagcatgatggaaagatcgataaggaggaatggagaaacttagtgttgcgacatccttcacttttgaagaacatgaccctccaatatctcaaggacattactacaacgtttccgagctttgtctttcattcaagagttgaggacacctaatttgggatttgacaagagaattatgattccatgaacatagtataacattctgtttgctctctacatggggttctataaaattc

SEQ ID NO: 627 - DNA, 1575 bp, Triticum sp.
  misc_feature (29)..(29): n is a, c, g, or t
aattcggcaccagtctccccctcctcttncttccggctcggctcctctgctgcgtgcggtggctcgccgcggtgggccccaccccctgcgaacccgcagcccaatcatgagcccgaaacggcaacgaggcccggacggggggtcggcgcaccccaaacgaacctcccaytccygakcccaccccagcgaaacaaacgacggggcggagacgagacgcgtcccgtccgcgcacgctactcgattgattgcttccttccgcccgctgctgctgctgccgctgccgccagagctcccctctcccccctccccctcctcgaatcccccggtgccctagccagcccgccgcccccgacgacgaccggcggcgagcgagagggcggatcgtgccccacgcgccgctccttcccctcccggagggagaccctgccgaggatcgagaccggccggccgcggaatgggcggccgcgatgactagcgggggtcgcgcggsggcgttgttggcggaggyagcggagcgcataccatggtgcagtgtctcgacggcgtgaagcacctcctcgcggtcctcttcaagtgctgcgacctcgagctcaagcagccgcgggggctcgaggacccccaggtcctcgcgcgggagaccgtctttagcgtgagcgaggtcgaggcgctgtacgagctcttcaagaagataagcagcgccgtgatcgatgacgggctgattaacaaggaggagttccaattagcgctcttcaagacgagcaagaaggagagcctcttcgctgatcgtgtattcgatttgttcgacacaaagcacaatggaattttagggtttgaagagtttgctcgtgcactctcagtgtttcacccaaatgcttcagttgaagagaaaattgacttttcattccagctatatgatcttaagcaacaaggcttcattgagagacaagaggttaagcagatggttgttgccacacttgcggagtcaggaatgaatctgtctgatgaaattatagagaacataattgataagacgtttgaggaggcagacacaaagcatgatggaaaaattgacagggaagagtggcacaatctggttcttcgacatccatctttactgaagaacatgactctccagtacctcaaggacatcaccacaacatttccaagcttcgtcttccattctcaggtcgacgatacctgaaattcttgcagttctttcgaatcggaacatcagaagataagcttgcggtaattttgtaaagttttggcatcggactgtttggaactttggatcggcagagagctagaggcctcggtgctctggaggatgttgaatttgagaacgcaaattgttgtcaaataactttgcttctttcatttgaagaatttagtattgttgggagcctttgggcaagctgttatctcttatctgaagttcccattttctcctctccccctttttggttttttgcctggttagcgatcaggtccaatcctctgggaattctgctttgtgtacaaaaatggaaacagccttgacattaaaaacctcggccgcgaccacgctgaatcatg

SEQ ID NO: 628 - DNA, 1326 bp, Triticum sp.
tggaaaacaataaattgcgaywywtttatcaacaaaggcatttctgctccgttcagttcaatccataatatacagtaggaaagttccccacacagaatacatacacagttaactaaagggtcaaaccagtttttttttgtacaaaaacgaaagaaactttgaacattctgatctactaccagcccaccctaagctaaagagaaaaaaacattatgaacacaaataaaccagcggaataatcgaatacagtatgatgtatgctttggaacactacgatggcttccgccaaaccatcagccggccattggaaaagcttaacaaagcagtgagaccgtcttctgatattccatcgaagtgaaaacactctcaggactttatgtatcgtcgacctgagaatggaacacaaagcttggaaatgtggtggtgatgtccttgagatattggagtgtcatgttcttcagtaatgagggatgtctgagaactagattgcgccattcttctttgtcaattttcccatcatgttttgtgtctgcctcctcgaaagtcttatcaatgatgctctctatgacttcatctgaaagattcattcctgattcagcaagtgtagcaacaaccatttgcttaacctcttgtctttcaatgaaaccttgttgcttcagatcataaagctggaaagagaagtcaattttctcatcaggaggggcacttggatgaaatactgataacgcacgggcaaattcttcaaatcctagaattccgttgtgttttgtgtcaaacaaatcaaagacacgatccgcaaacaaactctccttcttactggtcttgaaaagcgccaactgaaactcctccttgttgatcagcccgtcgtctatcacagcactgctgatcttcttgaacagctcgtacagcgcttcgacctcactsacgctgaacacggtctccctggcgaggacttcgggatcctccaggcccttgggctgcttgaggtcgatgtcgcagcacttgaggagcacgccgcccaggtgcctcaccccctccaggcactgcaacatggtggtggcaccactgcgcgccgcaaccgtccgtcaacgcccgtctctctctccagggtkggcgccgcgcaatccgcggggggctrgccgcaaatcgggaccccgcgggcggtggactggatttggccgaacgagccgagcggccacgcggggggcggcgtggctggaggatcgcggcagggtttcccgatgcggcgcggagcagaggggcggccggagggggtcgccgcggggttcctgtygtyggcysgysgtgcgaatgcggaacgcgtgg

SEQ ID NO: 629 - DNA, 1287 bp, Triticum sp.
gcacgagggacaggttttgctaaaaaaaaatcgacaggaagagcggacgtgcgggagagacgagcgatggctcgataggcatcctccccaggttcagatcccgacggcatcctccccaggttccagaaccgctgacgtggcgctcctcttcctcctcctctcgcctctcccatcaccgcctcgtctgcctcaccgccggcgaccgtcgctcccgtacccacactccgccgcagggatggctcaatgaggtgtgtgtgagccgcgttgatctggcttctggtggagtgtgaaatggtggatttcccggaagggttgcgacggctcgctgctctcctgctcaagtgctgcgatctcgacataccaaatcgtcccaagggcctcgaggatcctgagcgtctggcaagggaaacagtttttagcgtaaatgagattgaggcattgtatgagctgttcaagaagatcagcagtgctgtggttgatgatggtgtgattaataaggaagaattccaactggcgctgtttaagactaacaggaaagatagcatgtttgctgaccgggtgtttgatttgttcgacacraagcacaatgggattctagaatttgaagaatttgtgcgagctctttctgtattccatcctaatgcaccagttgatgacaaaattgattttgctttcaaactctatgatctcaaacaacaaggtttcattgaaaagcaagaggtgaagcaaatggtggttgccacacttgctgaatcaggaatgaacctttctgatgaggttatagagggtattatcgacaagacatttgaggaagcagatacaaagcacgatggtaaaatcgacaaggaggaatggcgcaatcttgtcttgaggcatccatctttgttgaagaatatgacactcccatatctaagggatattaccacaacatttccaagctttgtcttcaactctcaggtcgaggatgcttgagaatccagtttctaggttaccactgaagcttgtgaaaggccacggcagaccatgtcgtaggtggaccttgtgtatttttatttctttattcctttttggcgatatccttcttgtgcttggaacaattcttgtaattttttcacttctttaaaatgtgaattcccagcaatctcctcgtgtgagggctcttcttttgtatatacccgagtataatctagaattaactgttccttatgtataaacgctcttcayatacctagttgctcatgcgagtagcaactgataagcagcagttatattttatcgttccaaaaa

SEQ ID NO: 630 - DNA, 1422 bp, Zea mays
gccggccgggccggggctcckcsctccctccctccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagagagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatccacgggaaggaaggaaggacacaacacaaaggctcgcagggcggagaaggggaggaggaaggcgtgcagacaaggtcttcggtgttattattattacgctgttcctttgattttaatctccttttttttaaaaaaatatttgtcctatgggaatgggaggagaagaggtggagaagttgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtactaagcttctcgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttttaaaagaaccaaagttttactccccgtgggtttgcaaaattaaaagttttttttttggggcccccaaaatttaatttcctggcccgggttttaaaaacggggaaatgggaaaaaccttgggttacccaaattaaatccttttgaaaaaaatccctttttcccaagtgggga

SEQ ID NO: 631 - DNA, 1068 bp, Zea mays; identical to SEQ ID NO: 272

SEQ ID NO: 632 - DNA, 1359 bp, Sorghum bicolor; identical to SEQ ID NO: 277

SEQ ID NO: 633 - DNA, 1160 bp, Sorghum bicolor; identical to SEQ ID NO: 278

SEQ ID NO: 634 - DNA, 1172 bp, Sorghum bicolor; identical to SEQ ID NO: 279

SEQ ID NO: 635 - DNA, 1199 bp, Hordeum vulgare
cctcctcaaaatttccccaaaactcctcttccccttcttcttgccaaggaagcaaacagcgagcgagggcgtgcgcgaatggcggattcgtcggcgccgacgcgggtgatgatggcggtgaacgagtcgtcgctcaaggggtacccgcacccctccatcagctgccgctccgccttcgactggatgctctccaagctcgtccgctccaacaccgacggcttccacctcctcttcctccacgtccaggtccccgacgaggacggatttgatgatgtggatagtatatatgcatcaccgacggacttccagagcatgaagcagagagacaagataagagggattcacctacttgagtacttcgtgaatgaatgccatcgattggggataaaatgtgaagcttggaccaaacagggggatccaaaggaggttatctgccatgaggtgaagagagtccagcctgatcttctagttgtgggaagtagaggcctcgggccatttcagagggttttcttgggcgcggtgagcgagtactgcgtcaagcatgctgaatgccccgtcatcaccatcaagcgcaaggccaatgagactccccaggaccccatcgacgactgatgctctcgtgagaatgggatgttcttcactgcttgatgggtytaatgtacttacagaataaaatctgggagtggctgggaactagtagtacaaaccttgcagagcgcgccccaaaactagagtgaagaacgaaaacgccgctattatcgcggatggatcatggatgcctagtagacagacaagagtacaagacaagacactcttatcatatgatgagatacatcaagttgtgatgaacctaagctactgtgatgtgatgtgatgatcatgcggccgctatgaaagtatacgtagattcagtcggcaaatcgatccaagcacaaggtattcatgctagcatgtagagactactctggtttattcattcaagactagctcgatgcataataatttacacctgattaagcttctaacttttgactctagtgactcctattctgaagagaagatcattatttcttgatctacgtgatacactcggacaccggagaagaagcagaagcaagcttctcttcgttcgctactcataattacaggcaagatctctttctacttcctcctcacctccctttgggcagcggccgcca

SEQ ID NO: 636 - DNA, 849 bp, Hordeum vulgare
gttcggcacgaggccaaaactcctcttccccttcttcttgccaaggaagcaaacagcgagcgagggcgtgcgcgaatggcggattcgtcggcgccgacgcgggtgatgatggcggtgaacgagtcgtcgctcaaggggtacccgcacccctccatcagctgccgctccgccttcgactggatgctctccaagctcgtccgctccaacaccgacggcttccacctcctcttcctccacgtccaggtccccgacgaggacggatttgatgatgtggatagtatatatgcatcaccgacggacttccagagcatgaagcagagagacaagataagagggattcacctacttgagtacttcgtgaatgaatgccatcgattggggataaaatgtgaagcttggaccaaacagggggatccaaaggaggttatctgccatgaggtgaagagagtccagcctgatcttctagttgtgggaagtagaggcctcgggccatttcagagggttttcttgggcgcggtgagcgagtactgcgtcaagcatgctgaatgccccgtcatcaccatcaagcgcaaggccaatgagactccccaggaccccatcgacgactgatgctctcgtgagaatgggatgttcttcactgcttgatgggtttaatgtacttacagaataaaatctgggagtggctgggaactagtagtacaaaccttgcagagcgcgccccaaaactagagtgaagaacgaaaacgccgctattatcgcggatggatcatggatgcctagtagacagacaagagtacaagacaagacactcttatcatatgatgagatacatcaagttgtgatgaacct

SEQ ID NO: 637 - DNA, 1674 bp, Zea mays
gggaccctcgaggcacgaggccttctgtcactcggccgctctgccctctgctcaaaatttcccccaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgcttccaagccaagccatgccatgccactggagaatgagatgttcttcttcactgcttttataatgggttgatgtacaaaatacgatatggaagtggtgcctggaactagttcgcggagggttccaactcttgcacactgcgcccccaaaaactagagttgaagatgtaaaacgccgtcgtccgccgagggacgacgagagattgtacgtgatacatcgatcgagtctcgtgaacctaaaaagctgccgctacattattgttcgctcatgtgccaggcttcgctggaacgaacgccccgccccttatttgcccctgcccgtccacagccacagccacagcttgagcagggtacctgaagcccgcgtagtcctttggcacggcgtagcctttgggaacgccgacgagctggggctgttgctgatgcttaagctgacgccccttgttgctgccagcaagcttgccgtcgctcttccacgccggaggcttccccggcgcgaacttgatctcgaagccgtcgtcgatgtcgtggatcgtggcgcgggagctcgccacgggcttcatcgccgggcacttgatctcgaatccgccgcccttctccaggtcgcctccgacggagtaaaaaatacaaaaaaagacaaaaacaaaaaaaaaaaaagaaatcaaataataaaaaaacgagcataaaaccaagccatgtggaggagggctttaacaatggtcctgttaatgactggctcctcactgctcacctggtctgccgtatccagcactcagaatgtcgtgatgattataatcacccgccccatgttccaaatcatgctaagccaccgagggaacagatgttgcaaggtcactttttaaacctacaaccccttgattgaggccttcaataagttccccggattgagcaccaccggggacaagcagacgcacaggcggtagctcacccactttttctgccatacttccaacgaaaccaccggtggatgggcaactgctccggatgtaccgtttgcctggggatactg

SEQ ID NO: 638 - DNA, 2326 bp, Oryza sativa
ggtccagtccagccctcaaaaatttcccaaaaaactcctgccccttcttcttcttcttcttgccgaggaagccaaagcagcgggagcaaagcggagcgcaatggcggggtcgtcggagccgacgcgggtgatggtcgcggtgaacgagtcctcgatcaagggctacccgcacccctccatcagctgccgcgccgccttcgactggatgctctccaagctcgtccgctccaacgccgccggcttccacctcctcttcctccacgtccaggtccccgacgaggacggatttgatgatatggatagcatctatgcatctccaccagactttcagagaatgaaacagagagacaagataagagggcttcacttgctcgagcactttgtgaatcaatgccatcaactggagataaaatgtgaagcatggattaaacaaggggatccaaaggaagtcatctgcagcgaggtgaagagagttcaaccagatcttctagttgtgggaagtaggggccttggaccatttcagagggttttcgtgggcacagtgagcgagttctgtgttaagcatgccgactgtccagtcatcaccatcaaacggaaggccgatgaagcaccgcaggaccctgttgatgattgatcccttcaatgtcatacttgagaatgagatattcttcactgctcaatgggtttaatgtacaaaatacaatatggtagtagtgcttggaactagtacaaatctttgcccagtccaccccaaaactagagtgaagatgaagaacactattgcgacaagaggttgtatcctatatgagatacatccaagtttgttatgaacctaagctaccttgatgatgaatcacgtactgggcttcgcagaaatgaatgttccacctcttatctgcccttgcctgaccacatttgcagggtacctgaaacctgggggcatgggcatgccgtgctgcggatggtgttggggcatgccatgctgctgtggatggtgttggtgttggtgttgttgatgttgctgctgatgccctttgccgtctcccttgctgtcgttcttccatgctgcaggtttccctggggtgaacttgatctcgaagccgtcgtcgatgtcgtggatcatggcgcgggagctcgccatcggcttcatcaccgggtacttgatctcgaaccccttctccaggtcgccgccgacggcattgatgccgtagaactggtcctcggcggaggccgccctcttcttggagagccgccggccgcagagccggccgacgacgcaggcggcgacggcgaggaaggtgatcacggcgagcacggtgaacaccgggccgaacgagcccctggacgtggtggccggctgcgcgtgcatgatggagttggaggttgggtagtaacccatgggctgaggtaaagacgccatcttccacttctcttgtgtcactcttctgctggtttttagctcttgttgcaaagctactgctcactgctcttcactcttctctgcctcttcttgactaggaaatggcttgtgtgatggaatggaagtgtctccttgagctcagaggcaggggtggtccttttatgatggaggagatctttgaacgcattggggcgcgagaaaggcgagtgctttgggatctctttggagcagttcaatgcgagcttggaataacgtctcggtatgcagccgcagcctgccttcctgcctgttctctctctcactcactgttttcttccgtgcttttgcttttggacgttgcattggatcaaagcaaccgtcgcagcagggagaaggcccggccagcgacatcacatcgctttggcttcctttgattgctttcccaccttcgctttagcagattgtgggggcaacgaggaatgagcgccagggccactagactggtcgcctttcttgggcatgccgatggatggcagcagcagcttgccgtcgccattggcatgttgctgcctcctcctcctcctccaggcccctccttcaaattccctgaggtgacatcttgggggcctgttcatcataaggttttgctcttaccatgatttgttttcggtgaatgctctggctctcgattgaacagggtaggtgaactcgtgggcagtattattaggtctagcgtatgtacgaatagctacgtggaactcgttatgatggtcgatcgttgagatgcactctagtcctactgctagaaccaacgaggagttttagatgacgttgcagtctcctgtgatcaagtgtcgttttcaaaaaaaagaaaaaagaagaagaaggaaccacgcacttcaactcgaattagtttgcagagaattt

SEQ ID NO: 639 - DNA, 1529 bp, Oryza sativa; identical to SEQ ID NO: 71

SEQ ID NO: 640 - DNA, 1604 bp, Sorghum bicolor; identical to SEQ ID NO: 72

SEQ ID NO: 641 - DNA, 1619 bp, Sorghum bicolor
tactggatgagtgcgacacccaaacggccgaaccattgcttagagggagagagagcaggggagtgaccatttcttcgagggagagcgtgggtagtagtagtagcagcagcagcagcagcagcttgagagaaggaactagctggctgagagaagcaaaggacatggcttccttgcctgatcccacggtgtactaccccgcgtcctctaacgccatcctgcgcgcgcagccgtcgtccaccgcggcggcgtccaagggctcgttcggcccggtcttcgccgtgctcgcggtgatctccttcctcgccgtggccgcctgcgtcgtcggcaggctttgcggccgccggctctccaggaagaggtccgccgaccaggacttctacggctccgacgccgttggcggcgacctggagaagggcttcgagatcaagtacccgacgatgaagcccatggcgagctctcgcgccatgatccacgacatcgacgacggcttcgagatcaagttcgcgccggggaagcctgcggcgtggaagaacgacagcaaggccgacaacaaggggcgtcggcatcaggtccaggtccaggtccagggccacggccagcatcagcttcagcatcagcaccagcagcaccagctcgttggcattcccaaaggctacgccgtgcccaaggagtacgcgggcttcagataccctgcggaagccgtggtcaggcaggggcaaataaggggcggggcattcattccagcaaagcctggcacatgaacatatagcagcagcttaggttcacaactcgattgattgatgtatcacatatgatacgtggtacaatctctcatcatccctcgggcgaacgatagcgttttcatcttcactctagttttggggcgtactgtgcaaaagttccctacgcgaactagttccaggcacttccatatcgtgctttgtacattgacccattataagcagtgaagaatatctcattctccagtgacatggcttgtaaagcatcaatcgtcgacagggtcctgaggagcttcagtagcattccgttttatggtgatgacggggcattcggcatgcttaacgcagaactcgctcaccgtgcccacgaaaaccctctgaaatggcccaaggcccctacttcccacaactagaaggtcaggctggactctcttcacttcgctgcagataacctcctttggatccccatgtctgatccatgcctcgcattttatccctaactgatggcattggtttacaaagtactcaagcaaatgaagccctcttatcttgtctctccgcttcatttggtggaagtcctccggcgaagcatagatgctatccatgtcatcaaatccgtcctcgtcggggacctgaacgtggatgaagaggaagtggaagcccccggggttggagcggacgagcttggagagcgtccagtcgaaggcggtgcggcagctgatggaggggtgcgggtaccccttgagcgacgactcgttcaccgccatcatcactctcgtcggcgccgacgagtccgccattgcagcgcacgcacgcctcgctcgctcgctcgggctgccttcctcgtcaagaagaggagcctcgtgccttgtgcggacg

SEQ ID NO: 642 - DNA, 636 bp, Saccharum officinarum
cgcacgcggcttcggattcgcgattcgagccacgacccacgctttggtacacccgaactatgcacttatatgtaaggcagcccgagcgagcgagcgaggcggtcgtgcgctgaaatggcggactcgccccccccgactagagtgatgatggcggtgaacgagtcgtcgctcaaggtgtacccgcacccatccatcagctgccgcaccgccttcgactggactctctccaagctcgtccgcttcaaccccgggggctttcacttcctcttcattcacggtcaggtccccgacgaggacggatttgatgacatggatagcatctatgctttgacgatggactttcaccaaatgaagcacttatacaagataagagggctgcatttgcttgagtactttgtaaaccaatgccagtaattagggataaaatgcgaggcatggatcaggcatggggatacaaaggaggttatctgcatcgaagcgaagagagtccagcctgacccttttaattggggaaggaggggccttgggccattccagaaggttttcgtggtcacgatgagcaaggtgtcgtgttaatcatgctgaatgccctcgtcatcagcctgatacggaatgctacttaaaattcttcaagac

SEQ ID NO: 643 - DNA, 1196 bp, Saccharum officinarum
atctgctcaaaatttcccccaaaacttcgcctcttcttgacgaggaaggcagcccgagcgagcgagcgaggcgtgcgtgcgctgcaatggcggactcgtcggcgccgacgagagtgatgatggcggtgaacgagtcgtcgctcaaggggtacccgcacccctccatcagctgccgcaccgccttcgactggacgctctccaagctcgtccgctccaaccccgggggcttccacttcctcttcatccacgttcaggtccccgacgaggacggatttgatgacatggatagcatctatgcttcgccggaggacttccaccaaatgaagcacagagacaagataagagggcttcatttgcttgagtactttgtaaaccaatgccatcaattagggataaaatgcgaggcatggatcaggcatggggatccaaaggaggttatctgcagcgaagtgaagagagtccagcctgaccttctagttgtgggaagtaggggccttgggccatttcagagggttttcgtgggcacggtgagcgagttctgcgttaagcatgctgaatgccccgtcatcaccataaaacggaatgctactgaagctcctcaggaccctgtcgacgattgatgcttttcaagccatgtcactggagaatgagatattcttcactgcttataatgggttaatgtacaaaatacgatatggaagtgcctggaaatakttcgccgagggaacttttgcacactgcgccccaaaactagagtgaagatgaaaacgctatcgttcgcccgagggatgatgtgagattgtacgtatcatatgtgatacatcaatcgatcgagttgtgaaccttarctgctgctatatkktcatgtgccaggctttgstggaatgaatgccccgccccttatttgcccctgcctgaccacggtttcagcagggtatcttaagcccgcgtactccttcggcacggcgttacctttgggaatgccaacaacctggggctgctgatgcatatgctggccctggccctggacctggccctgattctgaccccccttgttgtccgccttgctgtcgttcttccacgccggaggcttccccggcgcgaacttgatctcgaaaccgtcttccatgtcttggatcatggcgcgagagctcgccatgggcttcatcttccggtacttgatctcaaacccttct

SEQ ID NO: 644 - DNA, 1138 bp, Triticum sp.
cggacgcgtgggcggacgcgtgggaaaatttccccaaaactcctcttccccttcttcttgccaaggaagcaaacagcaagcgagggcgtgcgcaaatggcggattcgtcggcgccgacgcgggtgatgatggcggtgaacgagtcgtcgctcaaggggtacccgcacccctccatcagctgccgctccgccttcgactggatgctctccaagctcgtccgctccaacaccgacggcttccacctcctcttcctccacgtccaggtccccgacgaggacggatttgatgatatggatagtatatatgcatcaccgacggacttccagagcatgaagcagagagacaggataagagggattcacctacttgagtacttcgtgaacgaatgccatcgattggggataaaatgtgaagcttggaccaaacagggggatccaaaggaggttatctgccatgaggtgaagagagtccagcctgatcttctagttgtgggaagtagaggcctcgggccatttcagagggttttcgtgggcacggtgagcgagttctgcgtcaagcatgccgagtgtccagtcatcaccatcaagcgcaaggccaacgaagctccccaggaccccatcgacgattgatgctttcgtgcagccgtggttactttgagaatgggatgttcttcactgctcgatgaattaatgtacaaaatacaatctggaagtgactgggaactggtacaaactttgcagagcgcgccccaaaactagagtgaagaacgaaaacgctatgatcgccgatggatcatggatgcctagtagtaaatgcctagcagacactctttatcatatgatgagatgcatcaagctgtgatgaacctaaaagctactgtgatgatcatgaaccgggctttgcggagacgaacgttccgccccttacttgcccttgcctgaccgcgccgttggcagccgcggggtacctgaaaccggcgtactccttcggcatgccggcctggggatgctggtggtggtgctgctgctgctgctgcgggcgccctctgttgtcggccttggcgtcggtcttccacgcggcgggcttccccggcgcgaacttgatctcgaagccgtcgtccatgtcgtcggacgcgtgg

SEQ ID NO: 645 - DNA, 934 bp, Hordeum vulgare
gcacgaggcagactcgtcgagagaccgcgcggatcgtgcagcgtgtcgcaggagagaagcccaagctctggtgcaggcagccatggcgggggaaacgggggcgacggcggcttcggggccggcagcgggcaagatgacgatggtggtcggggtggacgagagcgagcacagctactacgcgctgcagtggacgctcctccacttcttctccccggggcagcagcagtaccgcctcgtcgtcgtcacggccaagcccaccgccgcgtccgccgtcggcctcgccggaccaggtgccgcggacgtgctgccgttcgtggaagcggacctgaagcggagctcgctgcgcgtcatcgacaaggccaaggagctctgcgcgcaggcgcaggtgggcgatggtgtcttcgaagtggtggagggggatgcaaggaacgtcctctgtgaggcggtcgaaaggaatcacgcagagatgctggttgtgggcaaccatggctatggagcaatcaaaagggctgttcttggaagtgtgagcgactactgcacccaccacgcgcactgcaccgtgatgattgtgaagaagccaaagcacaagcactgagcaacgcccagccttgactggtcgctgaacccagtgatcggtatttgtgcatgtttgtgaataaatggatcgcagatgtcacagttcacaccttcagaagagtagtgaactcctgcaagtagctacatgtggattcttgtttgagatggtgaataactgatgcgcctcatcagaacactgttatttgtgattgcagattcatgcattgtacaagcgttgtatgtatatgtaaatttaatcaagactgcaagtcccttgcagtggacacgtgtgtttacttcttgtagaagtgtggtttgtaaattcattcctcttctgttcagatttttttttccttgc

SEQ ID NO: 646 - DNA, 908 bp, Hordeum vulgare; identical to SEQ ID NO: 75

SEQ ID NO: 647 - DNA, 1652 bp, Zea mays
tcggtcgaggcaggatccagaggtagctagccttggaggaggaagcatctgcgcctgcggccgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcctaccgccgcctccgccgtcggcctcgccggcccaggcgccgcggatgtgctgccgtacgtggaggcggatctcaagcgctccgccctgcgcgtcgtcgaaaaagccataggcctctgcacacaggcgagcgacgctgtgtttgaggcgctggagggggacgctaggaacgtcctctgcgaggctgtcgagaggcacggggccgagatgctcgtcgtcggcagccatggttacggagccattaaaaggtctgtaccatctgacctcactcacagcctcagctattttctcttctcttctcccctgtttcccaactacagagttgctgccatcttcattcgtcactggctgcaacgactaccactaacgaaattctaatttataagatgaatgaatgggaaccataattgacaggctcatctcctagaaatagatttcacatcgattgatggtgttcgagttagtacctgctaatgttcttttcacgcgctagggtggaaaaaaaaacgcgccagagtactatcttttttattgtgttttctattcacatggtttgcagctttgtatttctgcggcaaaaatatcagtaatgatatctgcacttgttggcaacatacagacgccaacttaacactttatatgtccatgactaatgaagtaggctttcctcaatgaactaggctaaccaagaattattttgtgcgcatgatttcaaataaaccaacaattgaaggggccttcttgttgaaacgtgatttaataacttagtaacgttcctcacaaatacctccatgtattgagacttgagagcaaaagaaataactattttgaaggatctatacactcagtttagtcgttttgatctgccctaaatacacatatcttcactctgtctgcgttctagggaacaatttactacaactacaatggccattgctttgcatttcaactctacatccctttcctcgtctacttcaaatgtcctttattttcgaaagctatagttccaagtgtctttgttttccccaaaagatctacttcaaatttattctggttctcatttcactttcgtattattgattgactgtcctcaaccttcctcagggctgttcttggaagtgtgagcgactactgtgcccatcacgcgcactgcaccgtgatgatagtaaagaagcccaagcagcacaagcactgatcaatgccgactgatcactacgtgtactgcaaataatttgtactaccccaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttc

SEQ ID NO: 648 - DNA, 929 bp, Oryza sativa
  misc_feature (893)..(893): n is a, c, g, or t
agacacttcgtgacttgtttccgtgagcgatcgacaggaggacatggcggaggaagcggcggcggcgtcgtcggcggcggaggggaggatgacgatggtggtaggggtggacgagagcaagcacagctactacgcgctgcagtggacgctgcgccacttcttcgccgccgccgccggccagccgccgcagtaccgcctcgtcgtcgtcaacgccaagcccaccgccgcctccgccgtcggcctcgccggcccaggcgccgcggatgtgctgccgttcgtggaggcggacctgaagaagagctccatgcgcgtcatcgagaaggccagggagctctgcgcccaggtgagtgatgctctgtttgaagtgctggaaggggatgccaggaatgttctttgtgagtctgttgagaggcatcaggcggagatgttggttgtcggaagccatggctatggagcaattaaacgagctgttcttggaagcgtgagtgactactgttctcatcatgcgcactgcaccgtgatgatagtaaaaaagccgaagcacaagcactgagtccatgagcggcggccccagcctggactgaacagtatcattcatgtatatatctaccaccaaattgtgaacgtatctgtgtgaataaattgtcattgtattgacacttctagtcagcttcagcatgaaggcatgtaccatatagcatgcactgtatatccttctacctcttggatcctggatcgagaaggtaaataatttatgtttgatatcttaaaacagtgcgtgttaatattcatgcgaaaaatatttcatgtctattacacatatgcatcgtcaagatattgcaagttctattgatctggaattgtgattttattagtgagaaatatttcacttnatctgtgtatgtgattcaacaagttgttgaccaggc

SEQ ID NO: 649 - DNA, 2005 bp, Oryza sativa
gaagcgtacacacacttcgtgacttgtttccgtgagcgatcgacaggaggacatggcggaggaagcggcggcggcgtcgtcggcggcggaggggaggatgacgatggtggtaggggtggacgagagcgagcacagctactacgcgctgcagtggacgctgcgccacttcttcgccgccgccgccggccagccgccgcagtaccgcctcgtcgtcgtcaacgccaagcccaccgccgcctccgccgtcggcctcgccggcccaggtacgcgcggcgccgcggatgtgctgccgttcgtggaggcggacctgaagaagagctccatgcgcgtcatcgagaaggccagggagctctgcgcccaggtgagtgatgctctgtttgaagtgctggaaggggatgccaggaatgttctttgtgagtctgttgagaggcatcaggcggagatgttggttgtcggaagccatggctatggagcaattaaacgagctgttcttggaagcgtgagtgactactgttctcatcatgcgcactgcaccgtgatgatagtaaaaaagccgaagcacaagcactgagtccatgagcggcggccccagcctggactgaacagtatcattcatgtatatatctaccaccaaattgtgaacgtatctgtgtgaataaattgtcattgtattgacacttctagtcagcttcagcatgaaggcatgtaccatatagcatgcactgtatatccttctacctcttggatcctggatcgagaaggtaaataatttatgtttgatatcttaaaacagtgcgtgttaatattcatgcgaaaaatatttcatgtctattacacatatgcatcgtcaagatattgcaagttctattgatctggaattgtgattttattagtgagaaatatttcactttatctgtgtatgtgattcaacaagttgttgaccaggcacaaacaagaatatgattaatcggtaaaaacgagtgaattttgaatggccggagaatggaggctacgcgggaatcgcgcgcgggaactactcccagccgctggcttgatcacagaggcagttttaagttcattacataaataaatacagtgtcacccctgctggttcccccctctgttcatcaatctactgtactggcctccttctcagctctcactattctggcacctacaattccaagcttatcacgacgatggtgaagggaggaaagccggtgatgctggtggggatcgacgatagcgaccatagctactacgcgctcgagtggacgctcaaacacttcttcgccctgggccagccgcaacagtaccacctcgtcttgctcacctctaagccccccgcatccgccgtcatcggcattgccggtctaggtacgacggagctgttgccgactttagaattggatctgaagcgcggtgccgccagagtaattgagaaggcaaaggagatgtgctcccaggtgatcgatgcgagctatgaggtgttagagggagacgcgaggaacatcctctgtgaggcagttgaaaggcatcatgcagatatgctggttgtgggcagccatggctatggggcatggaaaagggctgttcttgggagcgtgagcgactactgcagccatcacgcgcactgcaccgtgatgatcgtgaagaggcccaagcataacacgcatagctgaaaaacggaatcacactcgtcatcaagaagatctagtgccatttctacatgttttcgagttctaattttatttctaaattgtgtattagttcgtgtgtgtgtgtgaataaatcgtgacatagagtgaccaccttattctgcaatctgcatattgcaatagaataattaatttagaaatgcctgatgagttagccattttagtacttggattttctcagacgatgtgcaagatgtctgaattactccctctgttaaaaaaaaaaatcctaggtgaagatgtgactcctccttatacaacgaataagagtggtcacttcctctcct

SEQ ID NO: 650 - DNA, 779 bp, Sorghum bicolor; identical to SEQ ID NO: 76

SEQ ID NO: 651 - DNA, 911 bp, Sorghum bicolor
gaagggaaatataacattttcttacctaataaaatgtacatactcgcacacagctcacagtaaagaagttgcaatcacatatacgtcaacacattgatacaaatacattgttttgaggttcagagaacaatcaattattggtaattcccaatccccatgtagaaggattgcatgcatgcatcggatactacttgcagaagcaaccgaacgtgtgatggttgatgatccaattattcacaaactggcgcatatacacaactttgcagtacatattatttgaagtatacgtagtgatctgtcaaactggatcattgatcagtgcttgtgatgcttcggcttctttactatcatcacggtgcagtgcgcgtgatgggcgcagtagtcgctcacacttccaagaacagcccttttgatggctccgtagccatggctgccgacgacgagcatctcggcgtggtgcctctcgaccgcctcgcagaggacactcctagcgtccccctccaccgcctcaaacacggcgtcgctcacctgtgcgcagagtgctttggctttgtcgatgacgcgcagggcggttttcttgaggtccgcctccacgtacggcagcacatccgcggcgcctgggccggcgaggccgacggcggaggcggcggaaggcttggcggtgacgacgacgaggcggtactgctgcggctgtggcggcggcgggaagaagtgctgcagcgcccactgcagcgcgtagaagctgtgctcgctctcgtccaccccgaccaccatcgtcatcttccccggcggcggcgcggcttccgtccccgccgccaccgccggcgctgctgcttcctccgccatggctgtgctgtagcgctgactggctccctatagtgtctgtcctcctcgctcctcgaccctcgtgc

SEQ ID NO: 652 - DNA, 776 bp, Saccharum officinarum
  misc_feature (705)..(705): n is a, c, g, or t
ggctgagaggcatagctggctcctgattctgcgtgctgtacaaggaaggaacccaggaaagcgagctagctgtccaaccaacctgggagaggggatcgatccaggcgaggagcgaggaggacagtcaccgagaggtagcgagccatggcggaggaagcagcgtctgcccctgcgacggaagccgcgccgacggggaagatgacgatggtggtcggggtcgacgacagcgaccacagcttctacgcgctgcagtgggcgctgcagcacttcttcccgccggcgccccagccgcagcagtaccgcctcgtcgtcgtcaccgccaagccatccgccgcctccgccatcggcctcgccggcccaggcgccgcggatgtgctgccgtacgtggaggcggacctcaagaaaaccgccctgcgcgtcatcgacaaagccaaagccctctgcgcacaggtgagcgacgctgtgttcgaggcggtggagggggacgctcggaacgtgctctgcgaggcggtcgagaggcaccacgccgacatgctcgtcgtcggcagccatggctacggagccatcaaaagggctgttcttggaagtgtgagcgactactgcgcccatcacgcgcactgcaccgtgatgatagtaaagaagcccaagcagcacaagcactgatcaataatggtccaggttgacagatcactacgtatactgcanataatatgtactggaaagttttgtatgcgtccgtttgtgaataattggatcatcacccatacaccttcggg

SEQ ID NO: 653 - DNA, 712 bp, Saccharum officinarum
cgtgctgtacaaggaaggaacccaggaaagcgagctagctgtccaaccaacctggtagagaggatcgatccaggcgagaagcgaggaggacagacacgagaggagccagtcaccgagaggtagcgagccatggcggaggaagcagcgtctgcccctgcggcggcggggaggatgacgatggtggtcggggtcgacgacagcgagcacagcttctacgcgctgcagtgggcgctgcagcacttcttcccgccgggacagccgcagcagtaccgcctcgtcgtcgtcaccgccaagccatccgccgcctccgccatcggcctcgccggcccaggcgccgcggatgtgctgccgtacgtggaggcggacctcaagaaaaccgccctgcgcgtcatcgacagagccaaaggcctctgcgcacgggtgagcgacgctgtgtttgaggcggtggagggggacgctaggagtgtgctctgcgaggcggtcgagaggcaccacgccgagatgctcgtcgtcggcagccatggctacggagccatcaaaagggctgttcttggaagtgtgagcgactactgcgcccatcacgcgcactgcaccgtgatgatagtaaagaaacccaagcagcacaagcactgatcaataatggtccagtttgacagatcactacgtatactggaaataattgtactgcaaagttgggtatgcctccgtttgg

SEQ ID NO: 654 - DNA, 870 bp, Saccharum officinarum
gaacccaggaaagcgagctgtccaactccaagtgtcccaactcaccttgcgagagggatcgatccaggcgagcgaggaggacagcagaggagccggtcagccagaggtagctagcgccatggcggaggaagcagcagcgtctgcgcctgcggcggggacggaagcgccgccgccgggaaagatgacgatggtggtcggggtcgacgacagcgaccacagcttctacgcgctgcagtgggcgctgcagcacttcttcccgccggcgccccagccgcagcagtaccgcctcgtcgtcgtcaccgccaagccatccgccgcctccgccgtcggcctctccggcccaggcgccgcggatgtgctgccgtacgtggaggcggacctcaagaagaccgccctgcgcgtcatcgacaaagccaaagccctctgcgcacaggtgagcgacgctgtgttcgaggcggtggagggggacgctcggaacgtgctctgcgaggcggtcgagaggcaccacgccgagatgctcgtcgtcggcagccatggctacggagccatcaaaagggctgttcttggaagtgtgagcgactactgcgcccatcacgcgcactgcaccgtgatgatagtaaagaagcccaagcagcacaagcactgatcaatgctccaatttgactgagatcactacgtatactgcaaataatatgtactgtaaagttttgtatgcgtccgtttgtgaataatcggatcatcaaccatcagacattcggttgcttctgcaagtatccgatgcatgcaatccttctacatggggattgggaattacaaataatgaattgttctctgaacctcacaacgatatatgtatgaatgtgttgaagt

SEQ ID NO: 655 - DNA, 969 bp, Saccharum officinarum
  misc_feature (903)..(903): n is a, c, g, or t
ggctgagaggcatagctggctcctgattctgcgtgctgtacaaggaaggaacccaggaaagcgagctagctgtccaaccaacctgggagaggggatcgatccaggcgaggagcgaggaggacagcagaggagccggtcagccagaggtagctagcgccatggcggaggaagcagcagcgtctgcgcctgcggcggggacggaagcgccgccgccgggaaagatgacgatggtggtcggggtcgacgacagcgaccacagcttctacgcgctgcagtgggcgctgcagcacttcttcccgccggcgccccagccgcagcagtaccgcctcgtcgtcgtcaccgccaagccatccgccgcctccgccgtcggcctcgccggcccaggcgccgcggatgtgctgccgtacgtggaggcggacctcaagaagaccgccctgcgcgtcatcgacaaagccaaagccctctgcgcacaggtgagcgacgctgtgttcgaggcggtggagggggacgctcggaacgtgctctgcgaggcggtcgagaggcaccacgccgagatgctcgtcgtcggcagccatggctacggagccatcaaaagggctgttcttggaagtgtgagcgactactgcgcccatcacgcgcactgcaccgtgatgatagtaaagaagcccaagcagcacaagcactgatcaatgctccaatttgactgagatcactacgtatactgcaaataatatgtacttgtaaagttttgtatgcgtccgtttgtgaataatcggatcatcaaccatcagaccttcggtggttttgcaagattcgatgcatgccatcttttaacttgggatgggaattccaaaaagagatggctctggacttcaacaatatatatggttatggggtgactcnaccaccgaccatccaagaattgaatgatgattgacgcagaatcaatcgatgaacgatgggatgtat

SEQ ID NO: 656 - DNA, 906 bp, Triticum sp.
cgtcgacagaccgcgcggactgtgtagcgtgtcgcgggagagaagcccaaagctttggcggagccatggcggagggaacgggagcgacggcggcttcagggtcggcagcgggcaagatgacgatggtggtcggggtggacgagagcgagcacagctactacgcgctgcagtggacgctcctccacttcttctccccgggccagcagcagcagtaccgcctcgtcgtcgtcacggccaagcccaccgccgcgtccgccgtcggcctcgccggaccaggtgccgcggacgtgctgccgttcgttgaggcggacctgaagcggagctcgctgcgcgtcatcgacaaggccaaggagctctgcgcgcatgtgagcgatgctgtctttgaagtggtggaaggggatgcgaggaacgtcctctgcgaggcggtggaaaggcatcacgcagagatgttggtcgtgggcaaccatggctacggagcaatcaaaagggctgttctcggaagtgtgagcgattactgcacccaccacgcgcactgcactgtgatgattgtgaagaaaccaaagcacaagcactgagcaatgcccagccttgactcttcgctgaacccagtttgtgcatctttgtgaatttgtgcatctttgtgaataaatggatcgcagatgtcagagttcgcaacttcagaagttcagagtggtgaactcctgcaagtagcagacaatatcctagtacatgctacatgtggattcttgattgatatggtgaataactgatgatgtgcctcatcagaacagtgttatttgttatgcagatgcatcaattgcacgaatcctgtatgtgtatgtaatcaagactgcaagttccttgcagtggacacgtgtgtttgcttcttatcgaagtgtgatttgt

SEQ ID NO: 657 - DNA, 848 bp, Triticum sp.
gcccgtcgagagaccgcgcggactgtgtagcgtgtcgcgggagagaagcccaaagctttggcggagccatggcggaggaaaccggagcgacggcggcttcagggtcggcagcgggcaagatgacgatggtggtcggggtggacgagagcgagcacagctactacgcgctgcagtggacgctcctccacttcttctccccgggccagcagcagcagtaccgcctcgtcgtcgtcacagccaagcccaccgccgcgtccgccgtcggcctcgccggaccaggtgccgcagaggtgctgccgttcgttgaggcggacctgaagcggagctcgctgcgcgtcatcgacaaggccaaggagctctgcgcgcaggtgagcgatgctgtctttgaagtggtggaaggggatgcgaggaacgtcctctgcgaggcggtcgaaaggcatcacgcagagatgttggttgtgggcaaccatggctatggagcaatcaaaagggctgttcttggaagtgtgagcgattactgcacccaccacgcgcactgtactgtgatgattgtgaagaaaccaaagcacaagcactgagcaacgcccagctcagtgattagtatttgagctttcgtgtgtacagccaatgtgtgcatgtttgtgaataaatggatcgcggatgtcacaattcacaacttcagagtagcgaactcctgcaagtggcccacaatatcctacatgtggattcttgattgagatggtgaataactgatgacgtgcctcatcagaacagtgttatttgtgatgcagatgcatcaattgcacgaatgttgtatgtatatgtaatcaagactgcaagttccttgc

SEQ ID NO: 658 - DNA, 941 bp, Triticum sp.
aacgcacgaggccattccagacccgtcgagagaccgcgcggactgtgtagcgtgtcgcgggagagaagcccaaagctttggcggagccatggcggaggaaacgggagcgacggcggcttcagggtcggcagcgggcaagatgacgatggtggtcggggtggacgagagcgagcacagctactacgcgctgcagtggacgctcctccacttcttctccccgggccagcagcagcagtaccgcctcgtcgtcgtcacggccaagcccaccgccgcgtccgccgtcggcctcgccggaccaggtgccgcggacgtgctgccgttcgttgaggcggacctgaagcggagctcgctgcgcgtcatcgacaaggccaaggagctctgcgcgcaggtgagcgatgctgtctttgaagtggtggaaggggatgcgaggaacgtcctctgcgaggcggtggaaaggcatcacgcagagatgttggtcgtgggcaaccatggctacggagcaatcaaaagggctgttctcggaagtgtgagcgattactgcacccaccacgcgcactgcactgtgatgattgtgaagaaaccaaagcacaagcactgagcaatgcccagccttgactcttcgctgaacccagtttgtgcatctttgtgaatttgtgcatctttgtgaataaatggatcgcagatgtcagagttcgcaacttcagaagttcagagtggtgaactcctgcaagtagcagacaatatcctagtacatgctacatgtggattcttgattgatatggtgaataactgatgatgtgcctcatcagaacagtgttatttgttatgcagatgcatcaattgcacgaatcctgtatgtatatgtaatcaagactgcaagttccttgcagtggacacgtgtgtttgcttcytatcraagtgtgatttgtaaaaaaaaaaaa

SEQ ID NO: 659 - DNA, 837 bp, Triticum sp.
aacgcacgaggccattccagacccgtcgagagaccgcgaggactgtgtagcgtgttgcaggagagaagcccaagctttggcggagccatggcggaggaaacgggggcgacggcggcttcagggccggcggcgggcggagagggcaagatgacgatggtggtcggggtggacgagagcgagcacagctactacgcgctgcagtggacgctcctccacttcttctccccgggccagcagcagcagtaccgcctcgtcgtcgtcacggccaagcccaccgccgcgtccgccgtcggcctcgccggaccaggtgccgcggacgtgctgccgttcgttgaggcggacctgaagcgaagctcgctgcgcgtcatcgacaaggccaaggagctctgcgcgcaggtgagtgatgctgtctttgaagtggtggagggggatgccaggaacgtcctctgcgaggcggtagaaaggcatcacgcagagatgttggttgtgggcaaccatggctatggagcaatcaaaagggctgttcttggaagtgtgagcgattactgcacccaccacgcgcactgcaccgtgatggttgtgaagaaaccaaagcacaagcactgagcaatgcccagccttgactcttcgctgaacccagtgattggtatttgagctttcgtgtgccctgccagtttgcgcatctttgtgaataaatggattgtcgcagttcacaacttcagactagtgaactcctgcgagtagcccataataatcctacatgctacatgtggattattgattgagaatgtgaataactgatgtgcctcatcagaaacagtgttattgtgatgcaga

SEQ ID NO: 660 - DNA, 1048 bp, Hordeum vulgare
cggcacgaggccaccaccatcgtcgtccttaattgttcctgcgtcttccaccaccaccaccacctccaccacctgtcaagccgagcgacgagaagagaagggaagagagaagagatcgaccatggccgcggaaggcgagaggtgggtgggcctggcggtggacttctcggaggggagccgcgcggcgctgcagtgggcggcggacaacctgctccgctccggcgacaacctgctcctcctccacgtcctcaaggaccccgactacgagcagggcgagaccctcctctgggaggcctccggctcgcctttgatccccctctcggaattctctcacccttcggtcgcaaagaaatatggggtgaagcctgatgctgaaacactggacatgctcaacaccatagctaagcagaaggaggttgccgtggtttccaaagtcctgtttggagatccccgcgagaagctatgccaagccatccatgacatgcccatcagctgcctggtcattgggagcaggggccttggcaagctcaagagggtgctcttgggcagtgtcagcgattacgtcgtgaacaacgccgcgtgcccggtcaccgttgtcaagccagcgagcacccatgcctgatctcgtcatcgaaaatatcctcatctggtttagtttgttgagtcctatatatccagtcatggctgcaacttattgaaccatgcagtgttgttgtttgtaataatgattgacaattagcccgcggatgattcccaggttgtgtaatctgtgcatgtgtcgtgtacgtttgtgtgcttctcttcagcctaacttttgcaccgtgagtcagtccgtgctgctgtttgctgcatgcgtgatgtttatacagtttctagagtctgaataaaacggattctgctgttttttgttaaaaaaaaattaacctatttaacccacatttattaaatattatataaatacctcggggggggcccggcccccattccccttaagggggcggataaaaataatggcccggtgttacaccctgggaaggaaaaccccggg

SEQ ID NO: 661 - DNA, 1007 bp, Hordeum vulgare
cggcacgaggccaccaccaccatcgtcgtccttaattgttcctgcgtcttccaccaccaccaccacctccaccacctgtcaagccgagcgacgagaagagaagggaagagagaagagatcgaccatggccgcggaaggcgagaggtgggtgggcctggcggtggacttctcggaggggagccgcgcggcgctgcagtgggcggcggacaacctgctccgctccggcgacaacctgctcctcctccacgtcctcaaggaccccgactacgagcagggcgagaccctcctctgggaggcctccggctcgcctttgatccccctctcggaattctctcacccttcggtcgcaaagaaatatggggtgaagcctgatgctgaaacactggacatgctcaacaccatagctaagcagaaggaggttgccgtggtttccaaagtcctgtttggagatccccgcgagaagctatgccaagccatccatgacatgcccatcagctgcctggtcattgggagcaggggccttggcaagctcaagagggtgctcttgggcagtgtcagcgattacgtcgtgaacaacgccgcgtgcccggtcaccgttgtcaagccagcgagcacccatgcctgatctcgtcatcgaaaatatcctcatctggtttagtttgttgagtcctatatatccagtcatggctgcaacttattgaaccatgcagtgttgttgtttgtaataatgattgacaattagcccgcggatgattcccaggttgtgtaatctgtgcatgtgtcgtgtacgtttgtgtgcttctcttcagcctaacttttgcaccgtgagtcagtccgtgctgctgtttgctgcatgcgtgatgtttatacagtttctagagtctgaataaaacggattctgctgttttttgttacttacggacagccatttttcctgggctaggagttctaatgcccattgtagatgctagcaactttcagcatcaaaacaagtcacatcatatgat

SEQ ID NO: 662 - DNA, 972 bp, Zea mays
ttggctttggcatcatcaaatagacaagaggccacctctaccaccgccatccgcagtccatacagtgacccccacgaggtcaagaacctgtacgaggagaggaaagaacctggaagagaggagcttgaggagatggcgagcgccgagggcgagaggtgggtgggactggcgacggacttctcgcaggggagccgagaggcgctgcagtgggcggcgaccaacctgctccgcgccggcgaccacctgctgctgctgcacgtcatcaaggagcccgactacgagcagagcgaggccatcctctgggaatccaccggctccccgttgattcccctctcggagttctctgaccctattatcgcgaagaaatatggagcaaaacccgacatggaaaccttggacctcctgaacactacagctacccagaaggaaattatggtggttgtgaaagtcctgtggggagatccgcgtgagaagctctgtcaagttatccatgacaccccgttgagctgcttggttataggaagcaggggccttggcaaactcaagagggtgctcttaggaagtgtcagcgattacgtcgtgaacaacgcaacctgccctgtcaccgttgtcaagtcatcaagcaccgaaggttgatctcatcaccgaaatgcctgaatattgctgttgttataataaaagatggttggcctcatgaagaacatgcactagtttctagctacctgaaacatgttgaaccgggcaatcctattgtaataatagacaaagtgccttatgaagggcatggttatgtaataggtctgttctccagagtagatgtgccatgcttttgtgtcatcaccgaaagtgccttatgagtgatccttggcctattattcttctgctgcgctacagtgatgtctatgcttgtacttgaaagaatttccgtttgatctattttgactatgaaaatcgaaggaccgcatatttcat

SEQ ID NO: 663 - DNA, 1152 bp, Zea mays
aaatagtgcatgttcttcatcaggccaaccatctttattacaacatcacatccaggcatctcggcgataagatcaaccttcggtgcttgttgacttgacgacggtgacagggcaggttgcattgttcacaacatagtcgctgacacttcccaagagcaccctcttcgccgtccgaacccccgcggtacaatctgtgacaagtgtcctttggcttggcatccataggccaccgccatcagcagtccaatacagtgacctgacctccacgcgaagccaccaccacaactccacaagatctagaacctaagaacctgcagaggagaggaagaggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccggctccccgttgattcccctctcggaattctctgaccctatcattgcgaagaaatatggagcaaagccggacatagaaaccttggacatcctgaacactacagctacccagaaggatatcgtggtggttgtgaaagtcctgtggggtgatccgcgtgagaagctctgtcaagttatccatgataccccgctgagctgcttggttataggaagcaggggccttggcaagctcaagagggtgctcttgggaagtgtcagcgactatgttgtgaacaatgcaacctgccctgtcaccgtcgtcaagtcaacaagcaccgaaggttgatcttatcgccgagatgcctggatgtgatgttgtaataaagatggttggcctgatgaagaacatgcactagtttctagctatttgaaacatgttgaacgaggcaattctaatgtaataataatagacaaagtgccttatgaaggacatggttgacatgcctttgttgctgtatgagtgatgtttatagttttgagggtttgaagatgtggatcatttgcctattattcttccgctgtgctgtatgagcgatgtttatcaatatgcaatgcaaataaagaaacactacagatgcaaawwmaaaaa

SEQ ID NO: 664 - DNA, 1275 bp, Oryza sativa
  misc_feature (1158)..(1158): n is a, c, g, or t
  misc_feature (1207)..(1207): n is a, c, g, or t
gagtgacatccacaagccaagaagctgcaagagcaagccaagccaagccaagaacgaagcagcagcgagagcgaggtgagcagcgagcatggcgggcgaggcggcggcggcggagcggtgggtgggggcggcggtggacttctcggaggggagccgcgcggcgctgcggtgggcggcggacaacctgctccgcgccggcgaccacctcatcctcctccacgtcctcaaggaccccgactacgagcagggcgagaccctcctctgggaggccaccggctccccattgattcccctctcggatttctctgaacctacaattgcaaagaaatatggagcaaagcctgatgccgaaacattggacatgcttaatactgtggccaggcagaaggaggttgtggtggttttcaaagtcctttggggagatccccgtgagaagctatgccaagccatcaacgaaatccccatgagctgcttggttattggaagcaggggtcttggcaaactcaagagggtgctgttaggtagcgtcagcgactacgtcgtgaacaacgccacttgcccagtcacagttgtcaagacagccgatggttgatcctattgtcataaatatccatgtgttatatagtctgcttaaatctttgtccatctatctgaaacatattgaaccaccatgcagtgtaattgtaataataaacgaagtcaactgaagacgctcagttgtactttgtgcttgcactctctcagcctgactatgaaatggatccagctgtttttcttaccacaaaacataaaaacaaacaccaaaaccttgtcgggcgctcgggcagtcgatccagatcgagcaagtttgattggggcgaatacaatcacttggcagtcgctatggagtcgataaataatggcgcatacacgttgatgggaactcggtgcgtatgcttcaattccttcggagggtcaaagagcgagcctacatgggctgaggactgcatgttagtatgtactcatcgcctattatctgtcgtcagtccatatcttgtctccatactcgtcatgtcgtactacgtaggtagtagtaggtagaggcgcaccactgacagtactacgagctgatcgatacgtgatcgagcagttgtaagtagttcggtctgacgtgtgtcnagtagccacctagcacactcgaggttgctgcgacacgcactgacgtagntcgtagtcatcatgtaagagaagcgatctatcgatcacggaatcgacggagcaggctagtcagcgagt

SEQ ID NO: 665 - DNA, 838 bp, Oryza sativa
accttgcttccccatcccttccagcacagtgacctccacaagccaagaagctgcaagagcaagccaagccaagccaagaacgaagcagcagcgagagcgaggtgagcagcgagcatggcgggcgaggcggcggcggcggagcggtgggtgggggcggcggtggacttctcggaggggagccgcgcggcgctgcggtgggcggcggacaacctgctccgcgccggcgaccacctcatcctcctccacgtcctcaaggaccccgactacgagcagggcgagaccctcctctgggaggccaccggctccccattgattcccctctcggatttctctgaacctacaattgcaaagaaatatggagcaaagcctgatgccgaaacattggacatgcttaatactgtggccaggcagaaggaggttgtggtggttttcaaagtcctttggggagatccccgtgagaagctatgccaagccatcaacgaaatccccatgagctgcttggttattggaagcaggggtcttggcaaactcaagagggtgctgttaggtagcgtcagcgactacgtcgtgaacaacgccacttgcccagtcacagttgtcaagacagccgatggttgatcctattgtcataaatatccatgtgttatatagtctgcttaaatctttgtccatctatctgaaacatattgaaccaccatgcagtgtaattgtaataataaacgaagtcaactgaagacgctcagttgtactttgtgcttgcactctctgagcctgactatgaaatggatcctgctgtttttcttagcaatctgtgctgaacttgagcaattttttttcc

SEQ ID NO: 666 - DNA, 1268 bp, Sorghum bicolor
ctactggtttggtggtgcgcaggcgaatccaacctgaatcggggtcgccggagatcaaactgctttattgttggagatcaaattgctctctaggatggcttctagctagcacaagtagcttcatctcatttcctgtgagattgatcatgacttctgtgtgtcttttgcatggttgcagcgaggtgtaggcggacgctggaattattctaatcttgttattaggatcataaacaaaatattgtgactatcatatgttcttctgccacaaagttatggcacaacagcgtttcgttctttccccacgtcttgcaggaatggaatcatttcctgttaaagtttttgttcgtgcgcctatcatctgtgttgaaccagagttctcttcgtccttcaggaataaaataccgccttctgcagtccatagacggacctccacgaaaccaccaccagaccacgagcacaagaggtcaagaacctgacaacctgtacgaggagaggaggaggaggaggagatggccggcgccgagggcgagaggtgggtggggctagcgacggacttctcggaggggagccgggcggcgctgcggtgggcggcggccaacctgctgcgcgccggcgaccacctgctgctgctgcacgtcatcaaggagcccgactacgagcagagcgaggccatcctctgggaatccaccggctccccgttgattcccctctcggaattctctgaccctattatcgcgaagaaatatggagcaaagcccgacatagaaaccttggacatcctgaacactacagctacccagaaggagattatggtggttgtgaaagtcctgtggggagatccacgtgagaagctctgtcaagttatccatgacaccccgttgagctgcttggttataggaagcaggggccttggcaagctcaagagggtgctcttgggaagtgtcagcgactatgtcgtgaacaacgcaacctgccctgtcaccgtcgtcaagtcatcaagcaccgaaggttgatctcatcaccgaaatgcctgaatgtgttgttataataaagatggttggcctgatgaagaacatgcactagtttcttgctatctgaaacatgttgaaccaggcagttctattgtaataatagataaactaccttatgaaggacatggttgtgtaatagcactgtttgccagagtagatgtactatgcttttgttgctgtatgagtgatgtttatatctttgaggttttgaagaagtggatcctattattcttctgc

SEQ ID NO: 667 - DNA, 1142 bp, Saccharum officinarum
  misc_feature (1020)..(1020): n is a, c, g, or t
ttgtgggtacctgtccgtacctgtccggaatcccgggggggagaggaaacaacctgtaggagagcaggagaggagcttgaggaggaaatggccggcgccgagggcgagaggtgggtggggctggcgacggacttctcggaggggagccgggcggcgctgcggtgggcggcggccaacctgctgcgcgccggcgaccacctgctgctgctgcacgtcatcaaggagcccgactacgagcagagcgaggccatcctctgggaatccaccggctccccgttgattcccctctcggaattctctgaccctattatcgcgaagaaatatggagcaaaacccgacatagaaaccttggacatcctgaacactacagctacccagaaggagattatggtggttgtgaaagtcctgtggggagatccacgtgagaagctctgtcaagttatccatgacaccccgttgagctgcttggttataggaagcaggggccttggcaagctcaagagggtgctcttgggaagtgtcagcgactatgtcgtgaacaacgcaacctgccctgtcaccgtcgtcaagtcatcaagcaccgaaggttgatctcatcaccgaaatgcctgaatgtgttgttataataaagatggttggcctgatgaagaacatgcactagtttctagctatctgaaacatgttgaaccaggcagttctattgtaataatagacaaacgaccttatgatgaaggacatggttatgtatgagtgatgtttatattagggtttgaagaagtggatcctattattcttcgagatcaaccagattgcgcgaaaacatccacaaataaccgggggcgggccggctcttaaaggatgccaagacttcacgtgtacccgtttcatgtgacaagtacatcagctccttcctatagtgggtccccctaaggttcccattccctggcgccggctgtgttacacaacctgggggaagtgggaaaaccgtgggggttaacccatattatatgtctgtgccgnaattcccctcttcgccagttggggtaaaaacaagaggcccgccccatcgccttcccaacattgggccaccgaatggagaagggacgcccttttgcgggctttacgcggggggtgggggcacc

SEQ ID NO: 668 - DNA, 1109 bp, Triticum sp.
ccacgcgtccgaaatatcctctggccgacaagagaaggccaccaccgtcgtcgtcgtccttaattgttcctgcgtctcccaacttttccttccaaacagcggtgacctccaccaccacccaagagccgagcgaggagaagagaagagatcggccatggctgcggacggcgagaggtgggtgggcctggcggtggacttctcggaggggagccgcgcggcgctgcagtgggcggcggacaacctgctccgctccggcgacaacctgctcctcctgcacgtcctcaaggaccccgactacgagcagggcgagaccctcctctgggaggcctccggctcgcctttgatccccctctcggagttctctcacccttcaactgcaaagaaatatggggtgaagcctgatgctgaaacgctggacatgctcaacactatagctaagcagaaggaggtctccgtggtttcaaaagtcctgtttggagatccccgcgagaagctgtgccaagccatccatgacatgcccatcagctccctggtcattgggagcaggggccttggcaagctcaagagggtgctcttgggcagcgtcagcgattacgtcgtgaacaatgccgcctgccctgtcaccgttgtcaagccagcgagtaaccatgcctgatctcatcatcgcaaatgtccacatgtgttttagtttgccagagtcctatatatccagttggccgcaacttattgaaccatccagtgttatttgtaataataattgacaattagcctgtggatgattcccaggtgtgtgtaatctgtgcatgtgtcctgtacatcctgtacatttgtgtgcttatcttcagcctagcttttgctccatgagtcagtccgtgctgctgtttgttgcatacagtttgtagagtctgaataaaatggattctgctgtccaaaaaaaaaaaaaaaaaaaaaactcgagacgctgtggtgactgtatcggcgttgggttgagtgtttgctatttttatttttatttatgtggggggtgttgagcgtgagtcatggctgtgaataagcgtttgctgcatttggccgttgaccgccccaagaaataaaaactgagattgagg

SEQ ID NO: 669 - DNA, 1429 bp, Triticum sp.
accttcaataggaagccgcggggcgagtccagccgtccggattttacctagggcggggggcgggattaccattttcccccgggatccgggtgtgcgcgttgggcctattatgggtgcaatataggaacaagttttgccaaaaagcacgggtggtaccggtgccgaatttcccgggatttggttgacccacgggtccgccccaggggtccggaatttggggcacggggacccttaactgggactaagggagtggaaaaaacaggcggtagcttggaccacctccaccaccacccaagagccgagcgaggagaagagagaagaggagatcgaccatggctgcggacggcgagaggtgggtgggcctggcggtggacttctcggaggggagccgcgcggcgctgcagtgggcggcggacaacctgctccgcgccggcgacaacctgctcctcctgcacgtcctcaaggaccccgactacgagcagggcgagaccctcctctgggaggcctccggctcgcctttgatccccctctcggagttctctcacccttcaactgcaaagaaatatggggtgaagcctgatgctgaaacgctggacatgctcaacactatagctaagcagaaggaggttgccgtggtttccaaagtcctgtttggagatccccgcgagaagctgtgccaagccatccatgacatgcccatcagctccctggtcattgggagcaggggccttggcaagctcaagagggtgctcttgggcagcgtcagcgattacgtcgtgaacaacgccgcctgcccggtcaccgttgtcaagccagcgagtaaccatgcctgatctcatcgtcgcaaatgtctacatgtgttttagtttgccggagtcctatatatccagttggccgcaacttattgaaccatccagtgttatttgtaataataattgacaattagcctgtggatgattcccaggttgtgtaatctgtgcatgtgtcctgtacatcctgtacatttgtgtgcttatcttcagcctagcttttgctccatgagtcagtccgtgctgctgtttgttgcatgcgtgatgttcatacagtttctagagtctgaataaaatggatccgattctgcctcttaaaaagagcacgtcgcgcggcaagccaaccaggagggggggcccctctaaagtatccctgggggggcccaaggttcagcggccccggttttctttgacaaacggggtcccctatagtggggccgtataataaacactaggccgggcgccggcgggtttcaaaaggctcgggaatggggaaaaactgggaaccctggggacttttgcggaaaaggacacccacactcttggggggggggcaaaaatgttggaacaagctccccccacaggagttttaagcgcgcctacacgcgaaaattgaaaac

SEQ ID NO: 670 - DNA, 1067 bp, Triticum sp.
caagagaaggccaccaccaccgtcgtcgtccttaattgttcctgcgtctccccccttccttccaaacagcggtgacctccaccacctccaccaccacccaagagccgagcgaggagaagagagaagaggagatcgaccatggctgcggacggcgggaggtgggtgggcctggcggtggacttctcggaggggagccgcgcggcgctgcagtgggcggcggacaacctgctccgcgccggcgacaacctgctcctcctgcacgtcctcaaggaccccgactacgagcagggcgagaccctcctctgggaggcctccggctcgcctttgatccccctctcggagttctctcacccttcaattgcaaagaagtatggtgtgaagcctgatgctgaaacgctggacatgctcaacactatagcgaagcagaaggaggttgccgtggtttccaaagtcctgtttggagatccccgcgagaagctgtgccaagccatccatgacatgcccatcagctccctggtcattgggagcaggggccttggcaagctcaagagggtgctcttgggcagcgtcagcgattacgtcgtgaacaacgccgcctgcccggtcaccgttgtcaagccagcgagtaaccatgcctgatctcatggtcgcaaatgtctacatgtgttttagtttgccggagtcctatatatccagttggccgcaacttattgaaccatccagtgttattcgtaataataattgacaattagcctgtggatgattcccaggttgtgtaatctgtgcgtgtcctgtacatcctgtacatttgtgtgcttatcttcagcctaggttttgccccatgagtcggtccgtgctgctgtttgttgcatccgtggtgttcatacagtttctagagtctgaataaaatggattctgctgtccattgcagatgctagtaattttctttcagcattaaaagaacagtcacattacggttgcatctgatcccacagtggatcatgatgataatcctactagcgtgtgtatttgctttaagcaaagatcaaatggaagcagcaagcaag

SEQ ID NO: 671 - DNA, 1280 bp, Triticum sp.
cgctccgcgattggagcacgaggacactgactggacagaaggcctagaaaatctcccccgtcgtcgtcgtccttaattgttcctgcgtctccccacttctccttccaaacagcggtgcctccaccaccaccaccaccaccacccaagagccgagcgaggagaggagaggagaagacatcgaccatggctgcggacggcgagaggtgggtgggcctggcggtggacttctcggaggggagccgcgcggcgctgcagtgggcggcggacaacctgctccgcgccggcgacaacctgctcctcctgcacgtcctcaaggaccccgactacgagcagggcgagaccctcctctgggaggcctccggctcccctttgatccccctctcggagttctctcacccttcaactgcaaagaaatatggggtgaagcctgatgctgaaacacttgacatgctcaacaccatagctaagcagaaggaggttgctgtggtttccaaagtcctgtttggagatccccgcgagaagctgtgccaagccatccatgacatgcccatcagctgcctggtcattgggagcaggggccttggcaagctcaagagggtgctcttgggcagcgtcagcgattacgtcgtgaacaacgccgcctgcccggtcaccgttgtcaagccagcgagtaaccatgcctgatctcatcgtcgcaaatgtctacatttgttttagtttgctggagtcctatatatccagttggccgcaacttattgaaccatccagtgttatttgtaataataattgacaattagcctgtggatgattcccaggttgtgtaatctgtgcatgtgtcctgtacatcctgtacatttgtgtgcttatcttcagcttagcttttgcaccctgagtcaggccgtgctgctgcttgctgcatgcgtgatgttcatacagtttctagagtctgaataaaatggatccgattctgcctcttaaaaagagcacgtcgcgcggcaagccaaccaggagggggggcccctctaaagtatccctgggggggcccaaggttcagcggccccggttttctttgacaaacggggtcccctatagtggggccgtataataaacactaggccgggcgccggcgggtttcaaaaggctcgggaatggggaaaaactgggaaccctggggacttttgcggaaaaggacacccacactcttggggggggggcaaaaatgttggaacaagctccccccacaggagttttaagcgcgcctacacgcgaaaattgaaaac

SEQ ID NO: 672 - DNA, 884 bp, Triticum sp.
gacaagtgtcctttggcttggcatccataggccaccgccatcagcagtccaatacagtgacctgacctccacgcgaagccaccaccacaactccacaagatctagaacctaagaacctgcagaggagaggaagaggagcttggggaggagatggccggcgccgagggcgagaggtgggtggggctagcaacggattctcggaggggagccgggcggcgctgcsgtgggcggcggccaacctgctgcgagccggcgaccamctgctgctgctgcacgtcatcaaggagcccgactacgagcagagcgaggccatcctctgggaatccaccggctccccgttgattcccctctcggaattctctgaccctatyattgcgaagaaatatggagcaaagccggacatagaaaccttggacatcctgaacactacagctacccagaaggagattatggtggttgtgaaagtcctgtggggagatccacgtgagaagctctgtcaagttatccatgacaccccgttgagctgcttggttataggaagcaggggccttggcaagctcaagagggtgctyttgggaagtgtcagsgactwtgtcgtgaacawcgcaacctgccctgtcaccgtcgtcaagtcatcaagcaccgaaggttgatctcatcaccgaaatgcctgaatgtgttgttataataaagatggttggcctgatgaagaacatgcactagtttcttgctatctgaaacatgttgaaccaggcagttctattgtaataatagataaactwccttatgaaggacatggttgtgtaatagcactgtttgccagagtagatgtactatgcttttgttgctgtatgagtgatgtttatatctttgaggtttgaaga

SEQ ID NO: 673 - DNA, 1443 bp, Zea mays
cccccgcgtccgtgcccaacccaaccgctgcttttatttatacacctcctttggcctcttgcatcatcagctagtttacttgcgctgggcaagtctctagtgccagcttgtttacttgtagatccaggctctctcctctccaagcctttagcacagcaaagtcccagtgccatccctgttctgccgttgtatgtgaaccctcctatgcaatagcaagatctccatctctctcagctctctccagcttcatttccactcaagagttgagcacggatgaagaggccgaccagcagaggttcttcaatggtcagcgggcaagcaaccacagatctacaagaagatagctgcaggtccatggagccgcacggagtggacggcgatgctacggccgcggctgagcgcgacgacgtggacgccggggcgtacgacgaggaggtggacgaagaagaggagctcgcagggtcccgcggcggcctcggggagaagaagcggcggctggcggcggatcaggtgcgcgccctggagcggagcttcgaggtagacaacaagctggacccagagcgcaaggcccggatcgcgcgcgacctcagcctccacccgcgccaggtcgccgtctggtttcagaaccgccgcgcgcgctggaagaccaagcagatcgagcgcgacttcgccgcgctccgcgtgcgccacgacgcactccgcgtcgagtgcgacgcgctccgccgcgacaaagacgccctcgccgccgagataaaggagctgaggggcatggtggaaaagcagatggaggtgaagctggagtccgcggcggaggagctgctgccggtggcgacgaggtcagcagcagcagccgctgtgtataacaaggacgggtcgacggacagcgactcgagcgccgtgttcaacgaggaggcgtcgccctacccttactccggcgcggccttagaccatcagcagcagcaagaaaccagccacccgctgggcttcacgggtttcacctccttcttgacgtcctctttcccttccgtataccatggggattcgcatttggaccaggaagcggacggcttcttcagcgccgccgccgccggcgacggattcttcgccgaggagcagagcgcaggcatcggcagctggtacggcggtgagggttggtagaacagcaacagctaagctgttggctgcctggaggctggagatcactcttggtatcgtatctaccattcttgtaaaatatggcgctgtacattatattatgcatgcatgggtccgggacgcggtaactatatactactatgtagagttaatttatatggagtagttaatttctgtatttttcactggcgggctgaaagcctgaaacacgggctacgagaggagataggccgggtaatacggttattgttctataaatcttggttgacatgcagttaatttttagac

SEQ ID NO: 674 - DNA, 1191 bp, Zea mays
cgatttccttccttgcgtagctccattccactgcacaaacagcgcgccactttcccaattcccgtcgcgtggcctccttccgatcctggccactttgtgcgtcctgtagcgagggggtgatcggtgatggactgggggaacaggaccaaggccgccgccgccgctgcggcgccggacgagagggccgggggaggggaagggctcggaggatacgtcaaggtcatgaccgacgaacagatggaggtgctccgcaagcagatctccatctacgccaccatctgcgagcagcttgtcgagatgcatcgcgtcctcaccgagcaccaggacaccattgcaggattgaggtttagcaatctgtactgtgaccctctaatcatccccggcggtcacaagatcacggcaaggcagcggtggcaaccaacaccgatgcagctgcagatcctggagagcatcttcgaccagggcaacgggacaccgagcaagcagaagataaaggagataacagcggagctctcgcagcacggccagatctcggagacgaacgtgtacaactggttccagaacaggcgggcacggtcgaagcggaagcaggccgctgcttccttaccgaacaacgccgaatccgaagccgaggcggacgaggagcctctcgccgacaagaagccgaagtcagacaggccgccgccgccgccgccgccgatccaggataataccaaggctacgggcgctctcagcgccgacagggtctctggtgggacgcgtcacttggacacgggtcatgaccagaccagtggcgtgatgtatgggtgcaacgacagtggcttgttgagatcgtccggcagttcgggccagatgtccttgtacgagaacttcatgtcgaatccaagaatcgatcgtttcccggcgaaggtggagagctcccggagcttcccccatctccaacaacacggggaaggctttggcatgtttggatgacatgcatgctgctgcgctgagttgccgtgtgaaaaatggaggtcgacacagcgtgcgttcgatttgctgacgtgaaagttttatcttggatggtacgtgttgcttatcacggtctggttgaccacctccgcggatggtagctagctagcttgaacgaacctgctcttttggagtagctgtaagaggttgatatatagtagtatttgcacgtagtct

SEQ ID NO: 675 - DNA, 2187 bp, Zea mays
cgrgtcgcggcgcccgctcgtggccggtgcgcgcgtccacaaccgccgccaccgccttcccacttccaaatacgcctgctgccactttccccattcctgtctgaccatccccacgcccccctgctgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggagagctgcgtatcattgcattaagaagaaaagccgaatacaaatggcctgcgaggctgcaaccccgggcaaaggagtccgaagaggaaacccaaagaaaatataaagaaactactaaaaaagagaaggccaggtcacaaccactaactacaacttcctaagaatttcctgatccaagagcacgcaaaccagctgctccaacaaaacaccaaagattgcgctcatccataagggaccggagatttgcataaactttttttagctttcattaggtcattttttaaatattccgtattccaatgattcaccctaattacttacattgatggccgcacaacatcccacctgtccctttttagaataatctttaaaacagacttcactgaatttgcccttcctcctgtacaagtgttttaatgctcctttgtaatgtatgcattgtcgatggaatatagtcccttcttttttttcccgatcaactgggtttttgtttcttcttcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttcgtgtgtgtgaaaccatttcttgcttgcttttactytatgtytytwttgcatacggacatgggggcaacgatccctccccccaagtgttgacaatt

SEQ ID NO: 676 - DNA, 1591 bp, Zea mays
cgagtcgcggcgcccgctcgtggccggtgcgcgcgtccacaaccgccgccaccgccttcccacttccaaatacgcctgctgccactttccccattcctgtctgaccatccccacgcccccctgctgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttac

SEQ ID NO: 677 - DNA, 1985 bp, Zea mays
tgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcggggatggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggagagctgcgtatcattgcattaagaagaaaagccgaatacaaatggcctgcgaggctgcaaccccgggcaaaggagtccgaagaggaaacccaaagaaaatataaagaaactactaaaaaagagaaggccaggtcacaaccactaactacaacttcctaagaatttcctgatccaagagcacgcaaaccagctgctccaacaaaacaccaaagattgcgctcatccataagggaccggagatttgcataaactttttttagctttcattaggtcattttttaaatattccgtattccaatgattcaccctaattacttacattgatggccgcacaacatcccacctgtccctttttagaataatctttaaaacagacttcactgaatttgcccttcctcctgtacaagtgttttaatgctcctttgtaatgtatgcattgtcgatggaatatagtcccttcttttttttcccgatcaactgggtttttgtttcttcttcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatgacatgatgcggcgctgagttaccgtgtaaaatgtgatggttgacacatcgtgcgttcaatttgctgacatgaaagttgatgttggatgtccgtgttgcttatcacgttctggttaaccacctccgcggatggtagctagcttgaatgaacctactctttgggatagctgtaagaggttgatattatagtttgcccgtagtctatatacgctgaactatcagcatgtaattctccacgtttgcaaatttagcacgggtatgcagcagcctgtggttaaaccttcgtgtgtgtgaaaccatt

SEQ ID NO: 678 - DNA, 1543 bp, Saccharum officinarum
cccacgcgtccgctttccgccgcgacttgcggcgcccgctcgtggccggtgcgcgcgtccgcaaccgccaccaccgccttcacacttccaaatactcgtggcctcctgctgccacttttcccattcctgtctggccatccctcccggccctccgctctgctctggcctctgctctctcctgccattccacctgctgcccgctgccttccgttctgcgtcgcatggacttctgctgtcgccagccgcctccaaccgggtgcctgcctaaccggccgatttccttccttgcgtagctccattccactgcacaaatagcgcgccactttcccaattcccgtcgcgtggcccccttccgatcctggccactccgtgcgtcctgtggcgttcggcggggcgggggtgatcggtgatggagtggggggacagggccaaggcctccgccgccgcagtggcggccgacgagagggccggcggaggtgaagtgctcgggggatacgtcaaggtcatgaccgacgaacagatggaggtgctccgcaagcagatctccatctacgccaccatctgcgagcagctcgtcgatatgcaccgcaccctcaccgagcaccaggacaccattgcaggaatgagatttagcaatctgtacagtgatcctctaattatccctggaggtcacaagatcacagcaaggcaacgatggcaaccaacaccaatgcagctgcagatcttggagaacatctttgaccaaggcaatggaacaccaagcaagcagaagataaaggagataacagcagagctctcgcaccatggccaaatctcggagacaaatgtgtacaactgggttcagaacagacgggcacggtcaaagcggaagcaggccgyttctttaccaaatactagtaatgctgaatccgaagctgaggtggatgaggagtctctcaccgacaagaagcccaaagtcagataggttcactyccaggataacaaggcttatgggtggktcacagtgctgacaggatctcagggatgcatcacttcgacacagatcatgaccaaatcggtggcatgatgtatggatgcaatgacagcggcttgagatcgtctggcagttcgggccagatgtccttctacgagaacatcatgttaaatccaagtatcttctctggaaccagcgttgttacttcatttcattaggcaacgtaaaattccgaaaagagtgttactaaaagtttggcatcggttggtttgtgcaggaatcgatcatttcccggggaaggtggagagctcccggagcttctcccatctccaacacgggggaggctttgacatgtttggatgacatgctgctgccgttgagttaccgtgtaaaaagtgaaggttgacacagcgtgcgttcaatttgctgacatgaaagtttatcttggatgccaccgtgttgcttatcacggtctggttaaccacctccgcggatggtagctaacttgaatgaacctgctctttgtaatccagtaagaggttgatatatagtagtatttgcccgtagtct

SEQ ID NO: 679 - DNA, 2714 bp, Hordeum vulgare; identical to SEQ ID NO: 82

SEQ ID NO: 680 - DNA, 2881 bp, Zea mays
ctccaaccatctccgaggatctcgtcagtcgtcacgaaatctccatggctggagcacgcgagagaggccaggatacaccccaggtccccagccgcgcccgcgctatataaagctcccgccccccattcccttccccctcctcccccagctaggtagcttagctagcgtgataatcaccgcgctaaactgatcatatatacacagcaattggcgtgtgacaggacagaggaggagggggcaggctggtaatatctagcaaaagtacaagcgttcctccagtggcgtccagcgctatatagttcgctgtccggcgtcctttccgaccgagcgcgagcgatgacggtgacgccgaggattacggtgtgggatgggcggctggtggcgcacgggcggagcgtcctcgccggcgtgccggacaacatcgtgctcacgcacgcctccggggcggggctggtcgacggcgccttcgtcggcgccacggccgccgagcccagcagcatgcacgtcttcaccttcggcaccctccgggacctgcggttcgtgtgctgcttccggttcaagctgtggtggatgacccagcgcatgggcacctccggccgcgacgtcccgctggagacgcagttcatgctcctggagtgcggcccgggcgacggccacggcgacggcgacgcggcggtgtacgtggcgatgctgccgctgctggagggccagttccgggcggcgctgcagggcaacgaccgcgacgagctggagatcaccctcgagagcggggacaaggcggtgcagactgcgcaggggacctgcatgctgtacgtgcacgccgggaccaaccctttcgacaccatcactcaggcggtcaaggtggtggagagacacatgcagacgttccatcacagggagaagaaaaagctgccgtcgttcgtggactggttcggctggtgcacgtgggacgccttctacaccgacgtcaccgccgagagcgtcaagcaaggcctcaagagcttggcggacggcggcacgccgccgcggttcctgatcatcgacgacgggtggcagcagatcggcagcgagaacaaggaggagtccgccaacgccgtcgtccaggaaggggcgcagttcgccagtaggctgacggggatcaaggagaacgccaagttccagaagaagacgaagacgaaggagagcggcggcggcggcggcgagcagcaggcgcaaacgccgggcctgaagctgctggtggaggaggcgaagcgcgagcacggcgtcaggtacgtgtacgtgtggcacgccatggcggggtactggggcggcgtgaagccggcggcggaggggatggagcactacgagagcgcgctggcgtacccggtgcagtcgccgggtgtgatgggcaaccagccggacatcgtcatggactcgctgtccgtgctgggcctggggctggtgcacccgcgcagggcgctgagcttctacgacgagctgcactcgtacctcgcctcctgcggcgtcgayggcgtcaaggtggacgtgcagaacatcatckagacgctcggcgccgggcacggcggccgggtcgcgctcacccgcgcctaccaccgcgcgctcgaggactccgtggcgcgcaacttccccgacaacggctgcatctcctgcatgtgccacaacaccgacatgctctacagcgcgcgccagaccgccgtcgtgcgcgcctccgacgacttctacccgcgggacccggcgtcgcacaccgtccacgtctcctccgtcgcctacaacaccctcttcctcggcgagttcatgcagcccgactgggacatgttccatagcctgcacccggcggcggactaccacggcgcggcgagggcaatcggcggctgcccgatatacgtcagcgacaagccaggcaaccacaacttcgagctgctcaagaagctggtgctccccgacggctccgtgctccgcgcgcagctcccgggccgccccacccgcgactgcctcttcgccgacccggcgcgcgacggcacgagcctgctcaagatctggaacgtgaacaagtgcacgggcgtggtgggcgtgttcaactgccagggcgccgggtggtgccgcgtcaccaagaagacccgggtgcacgacgcggcgccggggacgctgacggggtcggtccgcgccgacgacgtggacgtgatcgccggcctcgccggggacggctggggcggcgaggccgtcgtgtacgcctacaggtcaggggagctagtcaggctgccccagggcgccacactgccggtgacgctcaaggtgctggagttcgaggtgttccacgtctcccccgtcagggcggtcgcgccgggcgtgtcgttcgcgcccatcggcctgctcgacatgttcaactccggcggggcggtggagcagtgcgaggtccgtggcggcgcgaacggtggcgcgggcgccgtcgtcgcgctcagggtccgcggctgcggccggttcggcgcgtactgctcgcggaggcccgcgaggtgcaggctggacgcggcggaggtggacttcagctacgacgacgacacggggctcgtcgcgctccatatccccgtgccggagcaggagttctacagatgggacctggagatcgatgtctagaggttctccctgcctgtcgatctgtggcaatggtgctttccgcctattcattcttgagtggttttaccattaaacgcgtgtgtggtcggtgtgtgtgtgtgtgctcgtgtgcgacatggagaggcgtgtgcaatgcatgatctgatcatgaaatggacacggtccgccattgacgcgcctctcttcgtccctagaagaataagctagcctctgctgtactgtctttgctgcatcaatatctgcatgcaat

SEQ ID NO: 681 - DNA, 2819 bp, Zea mays
gggccgccagcatctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcagcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaaacacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggcgacggcgacggcgagcaggcgccgggcgggctgaagcgactggtggccgagaccaaggacgcgcacggcgtgaagcaggtgtacgtgtggcacgccatggccgggtactggggcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcgcagcttcccggacaacggctgcatctcctgcatgtgccacaactccgacatgctctacagcgccaggcagaccgccgtcgtgcgcgcctccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcgagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctggtgacggcggcgggtgggacggcgagaccgtggtgtatgcgcaccgcacgcgggagctagtgcgactgccccggggcgtcgcgctgcctgtgacgctaggcccgctccagtatgaggtgttccatgtgtgcccgctccgcgccgtcgtgccgggggtctcgttcgcgcccgtcgggctgctcgacatgttcaacgccgggggcgccgttgaggagtgcgacgtgatcagcgatgacggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgctggtgccggagcaggagctatacctttggacgctggagattatgatctaggtcgtgatgctgtgcgccgacgccaacgcttgccttcgcggctgagccattatgagtgccattctgagccggacgacattgtcatttgctatgtgcacgagagatagatgtattgtggtggtgttgtataattggtatggcatggggagtgttttttttgttatgttcttatctgtatatcatacgtgctctgaatgttatataatacttgataataaaggatggtgctcctttaatacgratwa

SEQ ID NO: 682 - DNA, 2794 bp, Zea mays
attgtgttgggctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcggcacgctccgggactgccggttcctgtgcctgttccggttcaagctgtggtggatgacgcagcggatgggcgtctccggccgcgacgtccctctggagacccagttcatgctcgtcgaggtccctgccagtgacggcgacggcgacgacgcccccgcgtacgtggtgatgcttccgctgctggaggggcagtttcgggcagcgctgcaggggaacgaccgcgacgagctgcagatctgcatcgagagcggggacaaggcggtgcagacggaccaggccgcgcacatggtgtacctccacgccggcgacaaccccttcgacaccgtcaccgccgccgtcaaggcggtggagaagcacctgcagacgttccaccaccgcgacaagaagaagctgccgtcgttcctcgactggttcggctggtgcacctgggacgccttctacaccgacgtcaccgccgacggcgtcaaacacggccttcagagcctgtccaagggcggcgcgccgccgcggttcctcatcatcgacgacggctggcagcagatcgcctccgagaacaagcccgaccccaacgtcgccgtccaggagggcgcgcaattcgccagccggctgaccgggatcaaggagaacaccaagttccagaccaagcccgacggcgacggcgacggcgagcaggcgccgggcgggctgaagcgactggtggccgagaccaaggacgcgcacggcgtgaagcaggtgtacgtgtggcacgccatggccgggtactggggcggcgtgacgccgacggcggggacggcgatggagcgctacgagccggcgctggcgtaccccgtgcagtccccgggcgtgacgggcaaccagccggacatcgtcatggactcgctgtccgtcctggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcacagcttcccagacaacggctgcatctcctgcatgtgccacaactccgacatgctctacagcgccaagcagaccgccgtcgtgcgcgccgccgacgacttctacccgcgcgacccggcatcgcacaccgtccacgtcgcctccgtcgcgtacaacaccgtcttcctcggcgagttcatgcagcccgattgggacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcgagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctggtgacggcggcgggtgggacggcgagaccgtggtgtatgcgcaccgcacgcgggagctagtgcgactgccccggggcgtcgcgctgcctgtgacgctaggcccgctccagtatgaggtgttccatgtgtgcccgctccgcgccgtcgtgccgggggtctcgttcgcgcccgtcgggctgctggacatgttcaacgccgggggcgccgttgaggagtgcgacgtgatcagcgatgctggcggcaaggccatggctctcagggttcgcgggtgcggtcggttcggcgcttactgctcgcgggagccggcgaggtgcctattggactcggcggaagtggagttcagctacgatatcgacactggcctcgtgtccgtcgacttgctggtgccggagcaggagctatacctttggacgctggagattatgatctaggtcgtgatgctgtgcgccgacgccaacgcttgccttcgcggctgagccattatgagtcggacgacattgtcatttgctatgtgcacgagagatagatgtattgtggtggtgttgtataattggcatggggagtgttttttttgttatgttcttatctgtatatcatacgtgctctgaatgttatataatacttgataataaaggatggtgctccttttaaaa

SEQ ID NO: 683 - DNA, 2646 bp, Oryza sativa
ggagagggcaactaatactactagtatagtgtatattgccacgctaattactaattagcgtgaaataaaccaggagaagcagggtagggaggaagatgacggtgacgccgaggataacggtggcggaggggaggctggtggcgcatggccggaccatcctcaccggcgtggcggacaacatcgcgctgacgcacgcctccggcgccgggctcgtcgacggcgccttcgtcggcgccaccgccgacgagcccaagagccttcacgtcttcaccttcggcaccctccgggatttgaggttcatgtgctgcttccggttcaagctatggtggatgacccagcggatgggcacgtccggccgcgacgtcccgctggagacacagttcatgctcctcgagagccgcgacggcggcggcggcggcgaggcggtgtacgtcgtgatgctgccgctgctggaggggcagttccgggcggcgctgcagggcaacgaccgcgacgagctcgagatctgcatcgagagcggtgacaaggcggtgcagacggcgcaggggacgtacatggtgtacgtgcacgccggggccaatcccttcgacaccatcacccaagccgtcaaggtggtggagaggcatctgcagacgttccaccaccgggagaagaaaaagttgccgtcgttcttggactggttcgggtggtgcacatgggacgccttctacaccgacgtcaccgccgatggcgtcaagcaaggcctccaaagcttggcggaaggcggcacgccgccgcggttcttgatcatcgacgacgggtggcagcagatcggcagcgagaacaaggaggatgccggcaatgccgtcgtccaagaaggcgcccagttcgcgagcaggttgatcgggatcaaggagaacaccaagttccagaagacgacgacgacggcaatggcggatggcggcgagacggcggcgtcggcggcggggctgaaggcgttggtggaggaggcgaagaaggagcacggggtgaagtacgtgtacgtgtggcacgccatggcggggtactggggcggcgtgaagccggcggcggaggggatggagcactacgagagcgcggtggcgttcccggtgcagtcgccgggggtgatggggaaccagccggacatcgtcatggactccctctccgtgctcggcctcggcctcgtccacccgcgcatggcgctcgccttctacggcgagctccacgcctacctggcgtcgtgcggcgtcgacggcgtcaaggtggacgcgcagaacatcatcgagacgctcggcgccgggcacggcggccgcgtgtcgctcacgcgcgcgttccaccgcgcgctggaggcgtccgtggcgcgcagcttccccgacaacggctgcatctcctgcatgtgccacaacaccgacatgctctacagcgccaggcagaccgccgtcgtgcgcgcctccgacgacttctaccctctcgacccggcgtcgcacaccatccacatctcctccgtcgcctacaacaccctcttcctcggcgagttcatgcagcccgactgggacatgttccacgtatacgcttcgtcgccattgctgctcaatctactgctctgttcctgaatccaagatgatgatgatggtggtggtggtgatgtcatgaacttgcagagcttgcacccggcggcggagtaccacggcgcggcgcgggcgatcggcggctgcccgatctacgtcagtgacaagccgggtaaccacaacttcgagctgctcaagaagctcgtcctccccgacggctccgtgctccgggcacggctccccggccgccccacccgcgactgcctctttgtcgacccggcccgcgacggcgcaagcttgctcaagatatggaacgtgaacaagtgcaccggcgtggtgggcgtgttcaactgccagggcgccggctggtgccggatcaccaagaagacgcgcgtccacgacgcggcgccggggacgctcaccgggtcagtccgcgccgacgacgtcgacgccatcgccgacgtcgccggcacgggctggaccggcgacgccgtcgtgtacgcccacagatcaggtgagctgatcaggttgcccaagggagcgacgctgccggtgacgctcaaggtgctggagttcgagctgttccatgtctgccccgtcatgacggtggcgccgggcggcggcggcggcggcgttacgttcgcgccgatcggcctgctcgacatgttcaactccggcggagcggtggaggaatgcgacgtcgtccgtgccctcgacgccgcaggcgaggccgaggccgaggccgaggccgccgtcgtgcgccttagggcccgtggctgcggccggttcggcgcctactcctcccggcggccggcgcggtgcgcgctggacgccgtggaggtggagttcagctacgacgccgacacggggctcgtcgcgctcgacgtccccgtgccggcacatgagttgtacaaatggaccgtggagatccaggtctaggaggagcctgattcctgtgattctgtgtgagaggaatggaaaacatataatgctgtgccctctgcctgaataaaccctatatgtaccactgaacagtttgcataagcaataataaattactactctgtatgatgatgct

SEQ ID NO: 684 - DNA, 2708 bp, Oryza sativa
caatcttggttgagagggcaactaatactactagtatagtgtatattgccacgctaattactaattagcgtgaaataaaccaggagaagcagggtagggaggaagatgacggtgacgccgaggataacggtggcggaggggaggctggtggcgcatggccggaccatcctcaccggcgtggcggacaacatcgcgctgacgcacgcctccggcgccgggctcgtcgacggcgccttcgtcggcgccaccgccgacgagcccaagagccttcacgtcttcaccttcggcaccctccgggatttgaggttcatgtgctgcttccggttcaagctatggtggatgacccagcggatgggcacgtccggccgcgacgtcccgctggagacacagttcatgctcctcgagagccgcgacggcggcggcggcggcgaggcggtgtacgtcgtgatgctgccgctgctggaggggcagttccgggcggcgctgcagggcaacgaccgcgacgagctcgagatctgcatcgagagcggtgacaaggcggtgcagacggcgcaggggacgtacatggtgtacgtgcacgccggggccaatcccttcgacaccatcacccaagccgtcaaggtggtggagaggcatctgcagacgttccaccaccgggagaagaaaaagttgccgtcgttcttggactggttcgggtggtgcacatgggacgccttctacaccgacgtcaccgccgatggcgtcaagcaaggcctccaaagcttggcggaaggcggcacgccgccgcggttcttgatcatcgacgacgggtggcagcagatcggcagcgagaacaaggaggatgccggcaatgccgtcgtccaagaaggcgcccagttcgcgagcaggttgatcgggatcaaggagaacaccaagttccagaagacgacgacgacggcaatggcggatggcggcgagacggcggcgtcggcggcggggctgaaggcgttggtggaggaggcgaagaaggagcacggggtgaagtacgtgtacgtgtggcacgccatggcggggtactggggcggcgtgaagccggcggcggaggggatggagcactacgagagcgcggtggcgttcccggtgcagtcgccgggggtgatggggaaccagccggacatcgtcatggactccctctccgtgctcggcctcggcctcgtccacccgcgcatggcgctcgccttctacggcgagctccacgcctacctggcgtcgtgcggcgtcgacggcgtcaaggtggacgcgcagaacatcatcgagacgctcggcgccgggcacggcggccgcgtgtcgctcacgcgcgcgttccaccgcgcgctggaggcgtccgtggcgcgcagcttccccgacaacggctgcatctcctgcatgtgccacaacaccgacatgctctacagcgccaggcagaccgccgtcgtgcgcgcctccgacgacttctaccctctcgacccggcgtcgcacaccatccacatctcctccgtcgcctacaacaccctcttcctcggcgagttcatgcagcccgactgggacatgttccacgtatacgcttcgtcgccattgctgctcaatctactgctctgttcctgaatccaagatgatgatgatggtggtggtggtgatgtcatgaacttgcagagcttgcacccggcggcggagtaccacggcgcggcgcgggcgatcggcggctgcccgatctacgtcagtgacaagccgggtaaccacaacttcgagctgctcaagaagctcgtcctccccgacggctccgtgctccgggcacggctccccggccgccccacccgcgactgcctctttgtcgacccggcccgcgacggcgcaagcttgctcaagatatggaacgtgaacaagtgcaccggcgtggtgggcgtgttcaactgccagggcgccggctggtgccggatcaccaagaagacgcgcgtccacgacgcggcgccggggacgctcaccgggtcagtccgcgccgacgacgtcgacgccatcgccgacgtcgccggcacgggctggaccggcgacgccgtcgtgtacgcccacagatcaggtgagctgatcaggttgcccaagggagcgacgctgccggtgacgctcaaggtgctggagttcgagctgttccatgtctgccccgtcatgacggtggcgccgggcggcggcggcggcggcgttacgttcgcgccgatcggcctgctcgacatgttcaactccggcggagcggtggaggaatgcgacgtcgtccgtgccctcgacgccgcaggcgaggccgaggccgaggccgaggccgccgtcgtgcgccttagggcccgtggctgcggccggttcggcgcctactcctcccggcggccggcgcggtgcgcgctggacgccgtggaggtggagttcagctacgacgccgacacggggctcgtcgcgctcgacgtccccgtgccggcacatgagttgtacaaatggaccgtggagatccaggtctaggaggagcctgattcctgtgattctgtgtgagaggaatggaaaacatataatgctgtgccctctgcctgaataaaccctatatgtaccactgaacagtttgcataagcaataataaattactactctgtatgatgatgctatactctgttctagactgaatcactggttcaattgtaaattatagttgtgtt

SEQ ID NO: 685 - DNA, 2316 bp, Oryza sativa
atgacggtgacgccgaggataacggtggcggaggggaggctggtggcgcatggccggaccatcctcaccggcgtggcggacaacatcgcgctgacgcacgcctccggcgccgggctcgtcgacggcgccttcgtcggcgccaccgccgacgagcccaagagccttcacgtcttcaccttcggcaccctccgggatttgaggttcatgtgctgcttccggttcaagctatggtggatgacccagcggatgggcacgtccggccgcgacgtcccgctggagacacagttcatgctcctcgagagccgcgacggcggcggcggcggcgaggcggtgtacgtcgtgatgctgccgctgctggaggggcagttccgggcggcgctgcagggcaacgaccgcgacgagctcgagatctgcatcgagagcggtgacaaggcggtgcagacggcgcaggggacgtacatggtgtacgtgcacgccggggccaatcccttcgacaccatcacccaagccgtcaaggtggtggagaggcatctgcagacgttccaccaccgggagaagaaaaagttgccgtcgttcttggactggttcgggtggtgcacatgggacgccttctacaccgacgtcaccgccgatggcgtcaagcaaggcctccaaagcttggcggaaggcggcacgccgccgcggttcttgatcatcgacgacgggtggcagcagatcggcagcgagaacaaggaggatgccggcaatgccgtcgtccaagaaggcgcccagttcgcgagcaggttgatcgggatcaaggagaacaccaagttccagaagacgacgacgacggcaatggcggatggcggcgagacggcggcgtcggcggcggggctgaaggcgttggtggaggaggcgaagaaggagcacggggtgaagtacgtgtacgtgtggcacgccatggcggggtactggggcggcgtgaagccggcggcggaggggatggagcactacgagagcgcggtggcgttcccggtgcagtcgccgggggtgatggggaaccagccggacatcgtcatggactccctctccgtgctcggcctcggcctcgtccacccgcgcatggcgctcgccttctacggcgagctccacgcctacctggcgtcgtgcggcgtcgacggcgtcaaggtggacgcgcagaacatcatcgagacgctcggcgccgggcacggcggccgcgtgtcgctcacgcgcgcgttccaccgcgcgctggaggcgtccgtggcgcgcagcttccccgacaacggctgcatctcctgcatgtgccacaacaccgacatgctctacagcgccaggcagaccgccgtcgtgcgcgcctccgacgacttctaccctctcgacccggcgtcgcacaccatccacatctcctccgtcgcctacaacaccctcttcctcggcgagttcatgcagcccgactgggacatgttccacagcttgcacccggcggcggagtaccacggcgcggcgcgggcgatcggcggctgcccgatctacgtcagtgacaagccgggtaaccacaacttcgagctgctcaagaagctcgtcctccccgacggctccgtgctccgggcacggctccccggccgccccacccgcgactgcctctttgtcgacccggcccgcgacggcgcaagcttgctcaagatatggaacgtgaacaagtgcaccggcgtggtgggcgtgttcaactgccagggcgccggctggtgccggatcaccaagaagacgcgcgtccacgacgcggcgccggggacgctcaccgggtcagtccgcgccgacgacgtcgacgccatcgccgacgtcgccggcacgggctggaccggcgacgccgtcgtgtacgcccacagatcaggtgagctgatcaggttgcccaagggagcgacgctgccggtgacgctcaaggtgctggagttcgagctgttccatgtctgccccgtcatgacggtggcgccgggcggcggcggcggcggcgttacgttcgcgccgatcggcctgctcgacatgttcaactccggcggagcggtggaggaatgcgacgtcgtccgtgccctcgacgccgcaggcgaggccgaggccgaggccgaggccgccgtcgtgcgccttagggcccgtggctgcggccggttcggcgcctactcctcccggcggccggcgcggtgcgcgctggacgccgtggaggtggagttcagctacgacgccgacacggggctcgtcgcgctcgacgtccccgtgccggcacatgagttgtacaaatggaccgtggagatccaggtctag

SEQ ID NO: 686 - DNA, 2856 bp, Oryza sativa
gtctatctccctctcttttgaggagggcaccgccatttagttaattagtagttgttaattatcttcactaaccttaattaccctcacgcaaagcactctctaatcctcctcggcgctcgcataatcttgtatccctcatctcagattatcatcacctcgccgtgttagaaaaaagggagtaagttcgttttatcgtcggatttggtgagagttcgccggagtagaagaagatgacggtgacgccgcagatcacggtgagcgacgggaggctggcggtgcgggggcggacggtgctgaccggcgtgccggagaacgtgacggcggcgcacgcgtccggcgccgggctcgtcgacggcgccttcgtcggcgccgacgccggcgaggccaagagccaccacgtcttcaccttcggcacgctccgggaatgccggttcatgtgcctgttcaggttcaagctgtggtggatgacgcagaggatgggctcctccggccgcgacgtcccgctcgagacccagttcatgctcatcgaggtccccgccaccgccgccggcgacggccacgacggcggcggcgacggcgagccggtgttcgtggtgatgctgccgctgctggaggggaagttccgcgcggcgctgcagggaaacgacgacgacgagctccagatatgcatcgagagcggggataaggcggtgcagacagagcagggcgtgaacatggtgtacatccacgctgggaccaaccccttcgacacgatcacccaagccatcaaggcagtggagaagcgaatgcagacgttccaccacagggacaagaagaagatgccgtccttcttggattggttcgggtggtgcacatgggacgcgttctacaccgacgtcaccgccgacggcgtcaagcagggcctccgcagcctcgccaatggcggcgcgccgccgcgcttcctcatcatcgacgacggctggcagcagatcggcaccgaggacgacgacacggacgaacaccccgccgtcgccgtccaggagggcgcccagttcgccagccggctcaccggcatcaaggagaacgtcaagttccagagcaagaacggcggcgccggcgaggacacgccggggctgaggatgctggtggaggaggtgaagggggagcacggcgtccggcaggtgtacgtgtggcacgccatggccgggtactggggcggcgtggcgccggcgccggcgatggagcggtacgaggcggcgctggcgtacccggtgcagtcgccgggggtgacggcgaaccagccggacatcgtcatggactccctctccgtgctcggcctgggcctcgtccacccgcgcaaggtgctcgacttctacgacgagctccacgcctacctggcgtcgtgcggcgtcgacggcgtgaaggtggacgtgcagaacatcatcgagacgctcggcgccggccacggcggccgcgtcgcgctcacgcgcgcctacaaccgcgcgctcgaggcgtccgtggcgcggagcttcccggacaacggctgcatctcctgcatgtgccacaacaccgacatgctctacagcgcgcgccagaccgccgtcgtccgcgcctccgacgacttctaccctcgcgacccggcgtcccacaccatccacgtcgcctccgtcgcctacaacaccgtcttcctcggcgagttcatgcagcccgactgggacatgttccatagcttgcacccggcggcggagtaccacggcgcggcgagggcgatcggcgggtgtccgatctacgtcagcgacaagccggggaaccacaacttcgatctgctcaggaagctcgtcctccccgacggctccgtgctccgggcgcgcctccccggccgccccacccgcgactgcctcttctccgacccggcgcgcgacggcgagagtttgctcaagatatggaacctgaacaattgcggcggcgtggtcggggtgttcaactgccagggcgccgggtggtgcagggtggccaagaagacgcgcgtgcacgacgcggcgcccgggacgctcaccggcgccgtgcgcgccgacgacgtcgacgccatcgcgcaggtcgccggcggcgacggcggaggctgggacggggaggccgtggtgtacgcgcaccgggcgcgtgagctggtccggctgccgcgcggcgccgcgctgccggtgacgctcggggcgctcgagtacgaggtgttccacgtctgccccgtccgcgccatcgccgcggcgccgggcggcgccgccgtcgcgttcgcgcccgtcgggctcctcgacatgttcaacgccggcggcgccgtcgaggagtgcgccgtcgatgccgcagccgccgtggcgctcagggtgcgcggttgcggccggttcggcgcctacttctcgcggaggccggcgaggtgcgcgctcgacggcgccgacgtggggttcacctacgacggcgacacggggctcgtcgccgtcgacctgccggtgccggagcaggagatgtacaggtggaacctggagattcacgtctaggatgctgctgctgccacgtggcggtgcgatctttgccctctggtgttcgtggctgagacattcccagccgttggatcattgccattgatggtttgcagcagagatggacggaccgatggagagattgtgatgtgccctcttacgacttgcaacgcggtagagggagtatgctttgctacatctaaaatgaaagaagaaaattatagtatgcttttgtcatgttatggcttgtaaaatgcaataatatgatgtaatgctatggtttatgtattattattagctgataaataaaggatggtgctccttaaatatctgcaacccgggggaaccacta

SEQ ID NO: 687 - DNA, 2840 bp, Oryza sativa
cggccatctatctccctctcttttgaggagggcaccgccatttagttaattagtagttgttaattatcttcactaaccttaattaccctcacgcaaagcactctctaatcctcctcggcgctcgcataatcttgtatccctcatctcagattatcatcacctcgccgtgttagaaaaaagggagtaagttcgttttatcgtcggatttggtgagagttcgccggagtagaagaagatgacggtgacgccgcagatcacggtgagcgacgggaggctggcggtgcgggggcggacggtgctgaccggcgtgccggagaacgtgacggcggcgcacgcgtccggcgccgggctcgtcgacggcgccttcgtcggcgccgacgccggcgaggccaagagccaccacgtcttcaccttcggcacgctccgggaatgccggttcatgtgcctgttcaggttcaagctgtggtggatgacgcagaggatgggctcctccggccgcgacgtcccgctcgagacccagttcatgctcatcgaggtccccgccaccgccgccggcgacggccacgacggcggcggcgacggcgagccggtgttcgtggtgatgctgccgctgctggaggggaagttccgcgcggcgctgcagggaaacgacgacgacgagctccagatatgcatcgagagcggggataaggcggtgcagacagagcagggcgtgaacatggtgtacatccacgctgggaccaaccccttcgacacgatcacccaagccatcaaggcagtggagaagcgaatgcagacgttccaccacagggacaagaagaagatgccgtccttcttggattggttcgggtggtgcacatgggacgcgttctacaccgacgtcaccgccgacggcgtcaagcagggcctccgcagcctcgccaatggcggcgcgccgccgcgcttcctcatcatcgacgacggctggcagcagatcggcaccgaggacgacgacacggacgaacaccccgccgtcgccgtccaggagggcgcccagttcgccagccggctcaccggcatcaaggagaacgtcaagttccagagcaagaacggcggcgccggcgaggacacgccggggctgaggatgctggtggaggaggtgaagggggagcacggcgtccggcaggtgtacgtgtggcacgccatggccgggtactggggcggcgtggcgccggcgccggcgatggagcggtacgaggcggcgctggcgtacccggtgcagtcgccgggggtgacggcgaaccagccggacatcgtcatggactccctctccgtgctcggcctgggcctcgtccacccgcgcaaggtgctcgacttctacgacgagctccacgcctacctggcgtcgtgcggcgtcgacggcgtgaaggtggacgtgcagaacatcatcgagacgctcggcgccggccacggcggccgcgtcgcgctcacgcgcgcctacaaccgcgcgctcgaggcgtccgtggcgcggagcttcccggacaacggctgcatctcctgcatgtgccacaacaccgacatgctctacagcgcgcgccagaccgccgtcgtccgcgcctccgacgacttctaccctcgcgacccggcgtcccacaccatccacgtcgcctccgtcgcctacaacaccgtcttcctcggcgagttcatgcagcccgactgggacatgttccatagcttgcacccggcggcggagtaccacggcgcggcgagggcgatcggcgggtgtccgatctacgtcagcgacaagccggggaaccacaacttcgatctgctcaggaagctcgtcctccccgacggctccgtgctccgggcgcgcctccccggccgccccacccgcgactgcctcttctccgacccggcgcgcgacggcgagagtttgctcaagatatggaacctgaacaattgcggcggcgtggtcggggtgttcaactgccagggcgccgggtggtgcagggtggccaagaagacgcgcgtgcacgacgcggcgcccgggacgctcaccggcgccgtgcgcgccgacgacgtcgacgccatcgcgcaggtcgccggcggcgacggcggaggctgggacggggaggccgtggtgtacgcgcaccgggcgcgtgagctggtccggctgccgcgcggcgccgcgctgccggtgacgctcggggcgctcgagtacgaggtgttccacgtctgccccgtccgcgccatcgccgcggcgccgggcggcgccgccgtcgcgttcgcgcccgtcgggctcctcgacatgttcaacgccggcggcgccgtcgaggagtgcgccgtcgatgccgcagccgccgtggcgctcagggtgcgcggttgcggccggttcggcgcctacttctcgcggaggccggcgaggtgcgcgctcgacggcgccgacgtggggttcacctacgacggcgacacggggctcgtcgccgtcgacctgccggtgccggagcaggagatgtacaggtggaacctggagattcacgtctaggatgctgctgctgccacgtggcggtgcgatctttgccctctggtgttcgtggctgagacattcccagccgttggatcattgccattgatggtttgcagcagagatggacggaccgatggagagattgtgatgtgccctcttacgacttgcaacgcggtagagggagtatgctttgctacatctaaaatgaaagaagaaaattatagtatgcttttgtcatgttatggcttgtaaaatgcaataatatgatgtaatgctatggtttatgtattattattagctgataaataaaggatggtgctccttaaaaata

SEQ ID NO: 688 - DNA, 2829 bp, Sorghum bicolor; identical to SEQ ID NO: 83

SEQ ID NO: 689 - DNA, 2837 bp, Sorghum bicolor
cccgccagtttctccctcccagtcgagggagcaccattaccaagtactgtagtttagtgctgcttatattaccattactatattattattactgctgacttaattaccctcacgcggcgagtgaagccctctctacctttgattgattccgcacttgttgttcttgcgcgcattgcagagagggtgctctcgatccatctctgcagttttatctcttaggttttaatcaaatcaaatcaacatgacggtgacgccgtggatcacggtgagcgacgggacgctggcggtgcgcggccgcacggtgctcaccggcgtgctcgacaacgtgtccgcggcgcacgccgccggtgccggsctcgtcgacggggccttcgtcggcgcccacgccgccgagcccaagagccaccacgtcttcaccttcggcacgctccgggactgccggtttctgtgcctgttccggttcaagctatggtggatgacgcagcggatgggcgtctccggccgcgacgtgcctctcgagacccagttcatgctcatcgaggtccctcctgccgccaccgacggcgacggcaaacccgcgtacgtggtgatgctgccgctgctggaggggcagttccgggcggcgctgcaggggaacgaccgcgacgagctggagatctgcgtcgagagcggcgacaaggcggtgcagacggagcagggcgcgcgcatggtatacctccacgccggcgacagccccttcgacgccgtcaccgccgcggtcaaggcggtggagaagcacctgcagacgttccaccaccgagagaggaagaggatgccgtcgttcctcgactggttcggctggtgcacctgggacgccttctacaccgacgtcaccgccggcggcgtcaagcacggcctccagagcctgtccaagggcggcgcgccgccgcggttcctcatcatcgacgacggctggcagcagatcgcctccgacaacaagaagcccgacgaccccaacgtcgccgtccaggagggcgcgcaattcgccagtcggctgacggggatcaaggagaacaccaagttccagaccaagccggacggcgacggcgacggcgacggcgggctgaagcggctggtgtcggagaccaagggcgtgcacggcgtgaagcaggtgtacgtgtggcacgcgatggcggggtactggggcggcgtggcgccgtcgtcggggacagcgatggagcgttacgagccggcgctggcgtacccggtgcagtccccaggcgtgacggcgaaccagccggacatcgtcatggactcgctgtccgtcctgggcctcggcctggtgcacccgcggcgggcgcgggacttctacggcgagctccacgcgtacctggcctcctgcggcgtggacggcgtcaaggtggacgtgcagaacatcatcgagacgctgggcgccggccatggcggccgcgtcgcgctcaccagggcctaccaccgcgcgctcgaggcctccgtggcgcgcagcttccccgacaacggctgcatctcctgcatgtgccacaacaccgacatgctctacagcgccaggcagaccgccgtggtgcgcgcctccgacgacttctacccgcgcgacccggcctcccacaccgtccatgtcgcctccgtcgcctacaacaccgtcttcctcggcgagttcatgcagcccgactgggacatgttccatagcttgcacccggcggcggagtaccacggcgcggcgagggccatcggcggctgcccgatatatgtcagcgacaagccggggaaccacaacttcgagctgctcaggaagctcgtcctccccgacggctccgtgctccgcgcgcagctccccggccggcccacacgcgactgcctcttctccgacccggcgcgcgacggcgcaagcctgctcaagatctggaacctgaacaagtgcggcggcgtggtgggcgtgttcaactgccagggcgccgggtggtgccgcgtgacgaagcggacgcgcgtgcacgacgcggcgccgggcacgctgaccggcgccgtgcgcgccgacgacgtggacgccatagcgcgcgtcgccggcgacggcggcaacgatggcgacaacggcagcaacggcgagtgggacggcgaggccgtggtgtacgcgcaccgcgcgcgggagctggtgcggctgccgcgtggcgccgcgctgcccgtgacgctggcgccgctgcagtacgaggtgttccacgtgtgcccgctccgcgccgccgcgccgggggtggcgttcgcgcccgtggggctgctcgacatgttcaacgccgggggcgccgtcgaggagtgccgcgcagtggacggcggcgggaaggccgtggtggcgctcagggtgcgcgggtgcggccggttcggtgcctactgctcgcgggagccggcgaggtgcctgctggactcggcggaagtggagttcggctacgacgccgacaccggcctcgtgtccgtcgacctgccggtgccggagaaggagatgtaccggtggacgctggagattgtggtctaggccgttacacagtgcgccggcgcatgtcttggcggctgagccattctgagccgtaccaccattggtgccattttgcgatgtgcacgagagattgggagagcgcgtgcgatttgtggatgtagtgtctcgttatataattggtatgcgtgagagagtatgctttgctatgtcggtgtcagtataccctgtgtgctctgagtgttgtataatactgtagtactgggtaataaaggatggtgctccttcaatatgaatctcttctttaaacatgacttaatacatatcacattaccacttgttc

SEQ ID NO: 690 - DNA, 2751 bp, Triticum sp.
accacgcttccgcgactggagcacgaggacactgacatggactgaaggagtagaaactcccttcatccccctcttcggcgagggcagcgcaccatcttatcatatcattagattagtgctactagttccgattacccgcacacaaagcactctctatcactcttatcatataccatcgtccggcatctatcaagctccgtatcgaagcaagaaggggtggtcctttgaatctggtcgtcggagatgacggtgacaccgcagatcacggtgagcgacgggaggctggcggtgcgcggccggacggtgctctccggcgtgccggacaacgttaccgcggcgcacgcttccggggccgggctcgtcgacggggccttcgtcggcgccacggccggcgaggccaagagccaccacgtcttcaccttcgggactctccgcgactgccgattcatgtgcctgttccggttcaagctgtggtggatgacgcagcggatgggcacctccggccgcgacgtcccgctggagacccaattcatcctcatcgaggtccctgccgccgccggcaacgacgacggcgacagcgagccggtgtacctggtgatgctgccgctgctggaggggcagttccgaacggtgctccagggcaacgaccaagaccagctccagatctgcatcgagagcggggacaaagcggtgcagacggagcagggcatgaacagcgtgtacatccacgccggcaccaaccccttcgacaccatcacccaggccgtcaaggccgttgagaagcacatgcagacgttccaccacagggagaagaaaaaggtgccgtcgtttgtggactggttcgggtggtgcacgtgggacgccttctacacggacgtgacggccgacggcgtcaagcaggggctccgcagcctggcggagggtggcgcgccgccgcggttcctcatcattgacgacggctggcagcagatcggcagcgagaacaaggaagacccgagcgtcgccgtccaggaaggggcgcagttcgcgagcaggctcaccggcatcaaggagaacaccaagttccagagcgagcatgagcaggaggagaccccggggctgaagcggctggtggaggagaccaagaaggagcacggcgtcaagagcgtctacgtctggcacgccatggccggctactggggcggcgtcaagccgtcggcggccgggatggagcactacgagtccgcgctggcctacccggtgcagtcgccgggcgtcaccggcaaccagccggacatcgtcatggactcgctctccgtgctcggcctcggcctcgtgcacccgcgcaaggtctacaacttctacgacgagctccacgcctacctggccgcctgcggcgtcgacggcgtcaaggtggacgtgcagaacatcgtggagaccctcggcgccggccacggcggccgcgtcgcgctcacccgcgcctaccaccgcgcgctcgaggcctccgtcgcccgcaacttcccggacaacggttgcatctcctgcatgtgccacaacaccgacatgctctacagcgccaagcagaccgccgtcgtgcgcgcctccgacgacttctacccgcgcgacccggcgtcgcacaccgtccacatctcctccgtcgcttacaacacgctcttcctcggcgagttcatgcagcccgactgggacatgttccatagcctgcacccggcggcggagtaccacggcgcggcgagggccatcggcggctgccccatttatgtcagcgacaagccagggaaccacaacttcgaccttctcaagaagctggtgctccccgacggctccgtgctccgcgcacagctccccggcaggcccacgcgcgactgcctcttctccgacccggcgcgcgacggtgccagcttgctcaagatatggaacatgaacaagtgcgccggcgtggtgggggtgttcaactgccagggcgcggggtggtgtcgcgtcgtcaaaaagacaaggatccacgacgaggcgcccgggacgctcaccggctcggtgcgcgccgaggacgtggagggcatcacccaggccaccggcaccgacgactgcaccggcgacgccgtggtgtacacgcaccgggcgggggagctcgtgcggctgccccggggcgccaccctgccggtgacgctcaagaggctcgaatacgagctgttccacgtgtgccccgtccgcgccgtggcgccggacatctcgttcgcgcccatcgggttgctccacatgttcaatgccggcggtgccgtcgaggagtgcgtcgtcaggacgaacgaggacgacaaggccgttgtggcgctcagggtgcgcggctgcggccggttcggcgcctactgctcgcggaggccggcgaaatgctccctcgactcggctgacgtggagttcggctacgacgccgacacggggctcgtcacggtcgacgtgccggtcccggaggaggagatgtaccggtggacgctggagattcgggtctaggctggcatgctcgtgttcacgatcacggggctggctgaggcgatctcagccgttggattatttctttccattgttggtgcctatagtgcttaagagagattgatcgagagataaatattgccatgtagagagattatgctttgctctatcattgtggcaaatgcaataatgtatcccttctgtactatcattaagatttgaatgaatgcaataaaggatggtgctcccttgtaaatcgattactttcaa

SEQ ID NO: 691 - DNA, 2764 bp, Triticum sp.
accacgcttccgcgactggagcacgaggacactgacatggactgaaggagtagaracycccktcmkccccctcttcggcgagggcagcgcaccatcttatcatatcattagattagtgctactagttccgattacccgcacacaaagcactctctatcactcttatcatataccatcgtccggcatctatcaagctccgtatcgaagcaagaaggggtggtcctttgaatctggtcgtcggagatgacggtgacaccgcagatcacggtgagcgacgggaggctggcggtgcgcggccggacggtgctctccggcgtgccggacaacgttaccgcggcgcacgcttccggggccgggctcgtcgacggggccttcgtcggcgccacggccggcgaggccaagagccaccacgtcttcaccttcgggactctccgcgactgccgattcatgtgcctgttccggttcaagctgtggtggatgacgcagcggatgggcacctccggccgcgacgtcccgctggagacccaattcatcctcatcgaggtccctgccgccgccggcaacgacgacggcgacagcgagccggtgtacctggtgatgctgccgctgctggaggggcagttccgaacggtgctccagggcaacgaccaagaccagctccagatctgcatcgagagcggggacaaagcggtgcagacggagcagggcatgaacagcgtgtacatccacgccggcaccaaccccttcgacaccatcacccaggccgtcaaggccgttgagaagcacatgcagacgttccaccacagggagaagaaaaaggtgccgtcgtttgtggactggttcgggtggtgcacgtgggacgccttctacacggacgtgacggccgacggcgtcaagcaggggctccgcagcctggcggagggcggcgtgccgccgcggttcctcatcattgacgacggctggcagcagatcggcagcgagaacaaggaggacccgagcgtcgccgtccaggaaggggcgcagttcgcgagcaggctcaccggcatcaaggagaacaccaagttccagagcgagcatgaccaggacgacaccccggggctgaagcggctggtggaggagaccaagaaggagcacggcgtcaagagcgtctacgtctggcacgccatggccggctactggggcggcgtcaagccgtcggcggccgggatggagcactacgagtccgcgctggcctacccggtgcagtcgccgggcgtcaccggcaaccagccggacatcgtcatggactcgctctccgtgctcggcctcggcctcgtgcacccgcgcaaggtctacaacttctacgacgagctccacgcctacctggccgcctgcggcgtcgacggcgtcaaggtggacgtgcagaacatcgtggagaccctcggcgccggccacggcggccgcgtcgcgctcacccgcgcctaccaccgcgcgctcgaggcctccgtcgcccgcaacttcccggacaacggttgcatctcctgcatgtgccacaacaccgacatgctctacagcgccaagcagaccgccgtcgtgcgcgcctccgacgacttctacccgcgcgacccggcgtcgcacaccgtccacatctcctccgtcgcttacaacacgctcttcctcggcgagttcatgcagcccgactgggacatgttccatagcctgcacccggcggcggagtaccacggcgcggcgagggccatcggcggctgccccatttatgtcagcgacaagccagggaaccacaacttcgaccttctcaagaagctggtgctccccgacggctccgtgctccgcgcgcagctccccggcaggcccacgcgcgactgcctcttctccgacccggcgcgcgacggtgccagcttgctcaagatatggaacatgaacaagtgcgccggcgtggtgggggtgttcaactgccagggcgcggggtggtgccgcgtcgtcaaaaagacaaggatccacgacgaggcgcccgggacgctcaccggctcggtgcgcgccgaggacgtggagggcatcgcccaggccgccggcaccgacgactgcaccggcgacgccgtggtgtacgcgcaccgggcgggggagctcgtgcggctgccccggggcgccaccctgccggtgacgctcaagaggctcgagtacgagctgttccacgtctgccccatccgcaccgtggcgccggacgtctcgttcgcgcccatcgggctgctccacatgttcaacgccggcggcgccgtcgaggaatgcaccgtcaggacggacgaggacgacaaggccgttgtggcgctcagggtgcgcggctgcggccggttcggcgcgtactgctcgcggaggccggtgaaatgctccctcgactcggctgacgtggagttcggctacgacgccgacactgggctcgtcacggtcgacgtgccggtcccggagaaggagatgtaccggtggacgctggagattcgggtctaggctggcatgctcgtgttcacgatcacggggctggctgaggcgatctcagccgttggattatttctttccattgttggtgcctatagtgcttaagagagattgatcgagagataagatattgccatgtagagagattatgctttgctctatcactgtggcaaatgcaataatgtatcccttctgtactatcattaagatttgaatgaatgcaataaaggatggtgctccttgtaaaaaaaaaamaaaagggcgaccgctctga

SEQ ID NO: 692 - DNA, 2035 bp, Zea mays
cattgggtacctcgaagctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggatgagttgatgctggaggatggaggcatcgaggagagcccgcgccgcagcttcgaggactgcggtgattccgacgaggaggacgatgacaacgatgaggagcgggacggcgacggcgtcggttcgccgcgctccttccagtcccacaagtggccgcagagctacagggaaacaactgatacttacacaatcgctgcatcaccgagctttggttacttgggcccttctacaagcaaatactcactcctcgatcttggtcgtagtggtcttggttctgacctgaagttgcctctagtgtcggacaaggctgacggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgcaggcgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttatataccgagctatatacatattgtgtggaattcattattttggagggtgataacctcacaacaatttttcctaaagctggagttgattggtttggcattcatgttgatgggaagcattttttcggagtgttaaccgctattttagtcttgccaacagtatggctgcgagatcttcgagtgctctcttacctttcagccggtggtgtgattgcaactcttctagtattcctatccgtcggtttagtcggtgctacggatggtataggctttcattcaactgggaaggtagtaaactggagtggcatgccctttgccattggtatttacggattttgctactctgggcattcagtatttccaaatatctaccagtcaatgtccgatcgctctaagttccctaaggcactgttcatatgttttgcaatttgcacagcaatatatggatcttttgctgtcattggctttctcatgtttggagagaacactttatcccaaatcactttaaaccttccaaagcattcgattgcctcaaaagttgcactatggaccacggtgatcaaccctttcaccaaatatgccttgttgttaaacccactagctcgaagtttagaagagttgcgtcctgaaggttttttgaacgaaacatcatgctctattatactgaggactgcccttgttgcgtcaactgtatgcattgcctttcttctgccgttctttggtcttgtgatggctctcattggatctcttcttagtatacttgtggcggtcataatgccagccctgtgcttcctgaagatcgcacaaaacaaagcaacctgtgcacaggtaatcgcaagcatttgtatcgtaatgttgggcgtcatcagtgctgccctggggacatactcctccgtgaaaaagattgtagaaaactactaagctcttcgacaataattgcctgcctgcagaggctctaccaccagactccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatgcagttgtactgtaaaaaaattagc

SEQ ID NO: 693 - DNA, 2379 bp, Zea mays
cattgggtacctcgaagctcgtctcttctggaaccgtccctcgctcgtcatctcttccgccttcgctacgcaattcctgatccacgctgcgggccacttgtgacgactggcggaagcccgtcagagaaagaacagaggccggcaggcgagcggcgatcggagatggcgccggagaagccccggaaggaacaggaggaggagttgatgctggaggatggaggcatcgaggagagcccgcgccgcagcttcgaggactgcggcgactccgaggaggaccgcggggagggcgatgacgaggaggagcgggacagcgaccgcgacggcgtcggttcgacgcgctccttcctgccccaaaagtggccgcagagctacagggaaacaactgatacttacacaatcgctgcatcaccgagctttggttacttgggcccttctacaagcaaatactcactcctcgatcttggtcgtagtggtctgggttctgacctgaagttgcctctaktgtcggacaaggctgacggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgctggtgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttatataccgagctatatacatattgtgtggaattcattattttggagggtgataacctcacawcaatttttcctaaagctggwtttgattggyttggsattcatgttgatgggaagcattttttcggagtgttaactgctattttagtcttgccaacagtatggctgcgagatcttcgagtgctctcttacctttcagcgggtggtgtgattgcaactcttctcgtattcctgtccgttggtttagtcggtgctaccgatggtataggcttccattcaactgggaaggcagtaaactggagtggcatgccttttgccattggtatttatggattttgctactccgggcattcggtatttccaaatatctaccagtcaatgtccgatagatctaagttccctaaggcactgttcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttgggacagtttctctccgcagaggctactaccacacggttccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatttagttgtactgtagcaagttcctgtgctgccgattgttcctaggataagcttctgccttttacagttgaggcatctatatatacggcgacgactactgtacaatcagagtacaccttatgtacagtcaggatcagctagcactatattcttagaacttggtcgagtgcagcgaggatgcatgttcgttggccttttatggtgccmccatggtcgaagccatagcctgagcatgataatggcgccatgcactgttgtcttgtatcatatgcgctgttctatctcaagttctttttgaaggaagcaggcttgatttgtttgtagtgtgacgttttgtgtgtcaatgcaaaagaataatttggtga

SEQ ID NO: 694 - DNA, 2271 bp, Zea mays
ggcacgagggtcatctcttcgccttcgctacgcaattccgatccacgctgcgggccacttgtgacgactggcggaacccgcgagaaacagaggcgggcgagcggcgatcggagatggcgccggagaagccccggaaggaacaggaggaggagttgatgctggaggatggaggcatcgaggagagcccgcgccgcagcttcgaggactgcggcgactccgaggaggaccgcggggagggcgatgacgaggaggagcgggacagcgaccgcgacggcgtcggttcgacgcgctccttcctgccccaaaagtggccgcagagctacagggaaacaactgacacctacacaatcgctgcatcaccgagctttggttacttaggttcttctacaagcaaatactcgctcctcgaccttggtcgcagtattctgggctctgacctgaagtcacctctaatatcggccaaggctgattctgtcagaaacttgccgaaaacccttggttcaatgagagatgggagagtctcgtttcaattgcaacacacgggagaaatctacattagtcaagggtgcaatgtgacgcaaacagtcttcaacgggattaatgtgcttgctggtgttggccttctttccactccgtttacaattcatgaagctggatggactggccttgcagttctagcatgctttgcgattgtttgctgttatactggaattcttctaaaacattgttttgagagcaaagatggtatctcaagttatccagacattggagaggctgcatttggaagaattggccgtgtgttgatatctattattttgtataccgagctatattcatactgtgtggaattcatcattttggagggtgataacctcacatcaatttttcctaaagctggttttgattggcttgggattcatgttgatggaaaacattttttcggagtgttaactgctattttagtcttgccaacagtatggctgcgagatcttcgagtactctcgtacctttcagcgggtggtgtgattgcaactcttctcgtattcctgtccgttggtttagtcggtgttaccgatggtataggcttccattcaactgggaaggcagtaaactggagtggcatgccttttgccattggtatttatggattttgctactccgggcattcggtatttccaaatatctaccagtcaatgtccgatagatctaagttccctaaggcactgttcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatttagttgtactgtagcaagttcctgtgctgccgattgttcctaggataagcttctgccttttacagttgaggcatctatatatacggcgacgactactgtacaatcagagtacaccttatgtacagtcaggatcagctagcactatattcttagaacttggtcgagtgcagcgaggatgcatgttcgttggccttttatggtgcccccatggtcgaagccatagcctgagcatgataatggcgccatgcactgttgtcttgtatcatatgcgctgttctatctcaagttctttttgaaggaagcaggcttgatttgtttgtagtgtg

SEQ ID NO: 695 - DNA, 2143 bp, Oryza sativa
gactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccggaaggaggaggaggaggacgaggaggagatgacgctggaggacggcgacatcgaggagagcccgcgccgcagcttcgacgacgactacgaggacggcgggagcggcgacgacgaccgggatgacgacggcgaaggtttgggatcgcctcgctcgttccagtcccgccagtggccgcagagctaccgagaaacaactgacacctatacaattgctgcatctccgagctttggttacttgggtccctctacaagcaaatactcgatccttgatggtggtcgtagtagtctgggatccgacctgaagttgcccttgttgtctgataagctagatgggaagcaagactctgtcaagagcttgagaaagactcttggttcagcaatagataggaaaagctcgttacttacgcaacatactggagaagtctacatcgctcaaggatgcagtgtgacacagacggtgttcaatggggttaatgtacttgctggtgttggacttctttccactccatttacaattcatgaagctggatgggtaggccttgcggtcctagctatgtttgctattgtttgctgttatactggagttctgatgaaacactgttttgagagcaaagatggtatttctacatatccagacattggcgaggctgcttttggaaggattggtcgtctgctgatctctattatactctatactgagctatattcatattgtgtggaattcattattttggaaggagataatatgacatcaattttctctcatattggttttgattggcttggcgtccatattgatgggaaacatttctttggagtgttgactgctctaatagtcttgcctacagtatggttgagagatcttcgggttctctcctacctttctggtctcaacactcttaacctcaagtatttttctcactgcgatcattaatgatattaaggcagcaaattgaattgacaaggtttattgaatttcttgtgcagcgggtggtgttattgcaactcttcttgttttcctctctgtcgttttagttggcgctactgatggcgtagggtttcatttgactgggaaagcagtaaacttaggtggtataccgtttgctattggcatttatggtttctgctactctgggcactcagtgtttccaaatatttaccaatcaatgtcagaccgcacgaaattcactaaggcactgtttatatgctttgcaatttgcacagcaatatatggctcgtttgctatcattggctatctcatgttcggagataaaactctctcgcaaataactctgaatcttcctaaacattcatttgcctccaaggtcgcactgtggaccacggttatcaaccctttcaccaaatatgccctgttgttaaacccattggctcggagtttagaggagttgcgccctgaaggatttttgaacgaaacaatctgctctattatactgaggactgcccttgttgcgtcaaccgtgtgcattgcgtttcttatgccatttttcggtctcgtgatggctcttattggatctctgttgagtatacttgtggccgtcataatgcctgcactgtgcttcttgaagattaggcaaaataaagcaacgactgcccaggtcgttgcaagtattggtataataatattgggcaccataagcgctgctcttggaacatattcgtcggtactcagaattgtggagaactactaattacgaaacctagctcgcgtgcagtgcagttcccagcaggtgaggccacaggcatgtcatatctattactcaccccgcttacggttacggcgctcaaaaatggtcaaatatcgtgtgtttatcagaattttgctagaattaccgagttcactgtaattattcgacccaaccatgtaatgcatgtacctgcatagctgcttgcttctcagttccttgaagtggaatatctcc

SEQ ID NO: 696 - DNA, 2296 bp, Oryza sativa
gactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccggaaggaggaggaggaggacgaggaggagatgacgctggaggacggcgacatcgaggagagcccgcgccgcagcttcgacgacgactacgaggacggcgggagcggcgacgacgaccgggatgacgacggcgaaggtttgggatcgcctcgctcgttccagtcccgccagtggccgcagagctaccgagaaacaactgacacctatacaattgctgcatctccgagctttggttacttgggtccctctacaagcaaatactcgatccttgatggtggtcgtagtagtctgggatccgacctgaagttgcccttgttgtctgataagctagatgggaagcaagactctgtcaagagcttgagaaagactcttggttcagcaatagataggaaaagctcgttacttacgcaacatactggagaagtctacatcgctcaaggatgcagtgtgacacagacggtgttcaatggggttaatgtacttgctggtgttggacttctttccactccatttacaattcatgaagctggatgggtaggccttgcggtcctagctatgtttgctattgtttgctgttatactggagttctgatgaaacactgttttgagagcaaagatggtatttctacatatccagacattggcgaggctgcttttggaaggattggtcgtctgctgatctctattatactctatactgagctatattcatattgtgtggaattcattattttggaaggagataatatgacatcaattttctctcatattggttttgattggcttggcgtccatattgatgggaaacatttctttggagtgttgactgctctaatagtcttgcctacagtatggttgagagatcttcgggttctctcctacctttctggtctcaacactcttaacctcaagtatttttctcactgcgatcattaatgatattaaggcagcaaattgaattgacaaggtttattgaatttcttgtgcagcgggtggtgttattgcaactcttcttgttttcctctctgtcgttttagttggcgctactgatggcgtagggtttcatttgactgggaaagcagtaaacttaggtggtataccgtttgctattggcatttatggtttctgctactctgggcactcagtgtttccaaatatttaccaatcaatgtcagaccgcacgaaattcactaaggcactgtttatatgctttgcaatttgcacagcaatatatggctcgtttgctatcattggctatctcatgttcggagataaaactctctcgcaaataactctgaatcttcctaaacattcatttgcctccaaggtcgcactgtggaccacggttatcaaccctttcaccaaatatgccctgttgttaaacccattggctcggagtttagaggagttgcgccctgaaggatttttgaacgaaacaatctgctctattatactgaggactgcccttgttgcatcaaccgtgtgcattgcgtttcttatgccatttttcggtctcgtgatggctcttattggatctctgttgagtatacttgtggccgtcataatgcctgcactgtgcttcttgaagattaggcaaaataaagcaacgactgcccaggtcgttgcaagtattggtataataatattgggcaccataagcgctgctcttggaacatattcgtcggtactcagaattgtggagaactactaattacgaaacctagctcgcgtgcagtgcagttcccagcaggtgaggccacaggcatgtcatatctattactcaccccgcttacggttacggcgctcaaaaatggtcaaatatcgtgtgtttatcagaattttgctagaattaccgagttcactgtaattattcgacccaaccatgtaatgcatgtacctgcatagctgcttgcttctcagttccttgaagtggaatatcttcatcacttgcttataccgtgtttctgtcaatcactgttgttaggtctatccagcatgttacttaaaccgcctttagcaattatatgtactcaattaattatagatcgagattgctggatattgagtgttgcaacttgcaacccttgtttccaag

SEQ ID NO: 697 - DNA, 2037 bp, Triticum sp.
cacgccsarkawtttacctccctcccctaccatctcctctggaagcgtcgcgtgtggtcctacccaaatccgccacgcaacccggcatttgcgccacttgtgatggcggcggcggcggcgaggcagcggaaggaggaggaggacgagatgctgctggacgacggcgacatcgaggagagcccccgcgacagcttccgcgactccgacgacgagggggaggaggaggggcggggcgaggacggcgacggggtcggctccttcgagtcgcaccagtggccgcagagttaccgggaaacaactgacacctacacaattgcygcgtctcccatcttcggttaccttggtccttcaaccagcaaatactcaatcgatggtggccgcagtggcctggcttctgacctcaggctgcctttcatctcggataagctagaatctgtcaagagcctgcggcgacatcttcttggttcagtcagagatgagaagctctcatttcagtatactggagagatctacgtcggtcaagggtgcagcgtaacacagacagtcttcaatggtrttaacgtactcgctggtgttggccttctttctgctccgttcacaattcatgaagctggatgggctggtcttgcagttctgtctgtttttgcaattatttgctgttatactggagttcttctcaarcattgtttcgagagcaaagacggyattgcaacctatccagacatcggggaggccgcctttggaagaattggccgcttgatcatatctattattttgtatactgaattatattcatactgcgtggaattcattatactggaaggtgataatatgacatcaatctttcctgacgtcaatattaatttgtttgggattcatgtcgacagtaaacatttctttggagtgttaactgcwctggtagtyctgcccacagtatggctgcgagatctgcgagtgctatcatacctttcagccggtggtgtgattgcaactcttgtggtgtttatatctgtcgctttagtcggcaccactgaaggtgtagggttccatcagaccggggaagcagtaaagtggagtggcatgccctttgctattggtatttacggtttctgctactctgggcattcggtatttcctaatatctaccaatcaatgtctgatcgcacaaaattccctaaggcactttttatatgcttcgtagtttgcacagcgatatatggctcgtttgctattattggctatctcatgtttggtgacaagactctgtcgcaaataactttgaatcttccaaaagagtcatttgcctcgaaagttgctctgtggaccacggtgatcaaccctttcaccaaatttgccttgttgttaaacccattggctcggagtttagaagagttgcgcccygaaggatttttgaacgaaacaatcgtctctattatactgaggacgagccttgtggcgtcaactgttgtcattgcatttcttcttccattcttcggtttggtgatggctctgattggatccctgctcagtatacttgtggcagtcataatgcccgccttgtgcttcttgaagatcacacagaataaagccacacgcccgcaggtgattgcaagcgtggctataatagtggttggagtcatcagtgctgccctcggaacatactcctcggtggctagcataatcggatactactaattcttccaaagcaatctcttcgacagctctcagtaccgtcactcttggcaagagtttttgctgtgtatcatcgaattttaccgtgctctatgtacatccttcgacctagtatagtcgatttataaagactgcatctctagcaacaatgcattattgttaccatttagctgctgctatatcatttggtgtaccatatttctgccaagccctgcggtttaaatattgcctctttttagggctaaaaccaactttagtaacccgaaatattgtttgttgctattcatttattttttaggggaaacgtcaactttattaatccgaaatattgcctgttgttccgca

SEQ ID NO: 698 - DNA, 2026 bp, Triticum sp.
cctccctcccctaccatctccatctcctctggaagcgtcgcgtgtggtcctacccaaatccgccacgcaacccggcatttgcgccacttgtgatggcggcggcggcggcgaggcagcggaaggaggaggaggacgagatgctgctggacgacggcgacatcgaggagagcccccgcgacagcttccgcgactccgacgacgagggggaggaggaggggcggggcgaggacggcgacggggtcggctccttcgagtcgcaccagtggccgcagagttaccgggaaacaactgacacctacacaattgccgcgtctcccatcttcggttaccttggtccttcaaccagcaaatactcaatcgatggtggccgcagtggcctggcttctgacctcaggctgcctttcatctcggataagctagaatctgtcaagagcctgcggcgacatcttcttggttcagtcagagatgagaagctctcatttcagtatactggagagatctacgtcggtcaagggtgcagcgtaacacagacagtcttcaatggtgttaacgtactcgctggtgttggccttctttctgctccgttcacaattcatgaagctggatgggctggtcttgcagttctgtctgtttttgcaattatttgctgttatactggagttcttctcaagcattgtttcgagagcaaagacggtattgcaacctatccagacatcggggaggccgcctttggaagaattggccgcttgatcatatctattattttgtatactgaattatattcatactgcgtggaattcattatactggaaggtgataatatgacatcaatctttcctgacgtcaatattaatttgtttgggattcatgtcgacagtaaacatttctttggagtgttaactgcactggtagtcctgcccacagtatggctgcgagatctgcgagtgctatcatacctttcagccggtggtgtgattgcaactcttgtggtgtttatatctgtcgctttagtcggcaccactgaaggtgtagggttccatcagaccggggaagcagtaaagtggagtggcatgccctttgctattggtatttacggtttctgctactctgggcattcggtatttcctaatatctaccaatcaatgtctgatcgcacaaaattccctaaggcactttttatatgcttcgtagtttgcacagcgatatatggctcgtttgctattattggctatctcatgtttggtgacaagactctgtcgcaaataactttgaatcttccaaaagagtcatttgcctcgaaagttgctctgtggaccacggtgatcaaccctttcaccaaatttgccttgttgttaaacccattggctcggagtttagaagagttgcgccccgaaggatttttgaacgaaacaatcgtctctattatactgaggacgagccttgtggcgtcaactgttgtcattgcatttcttcttccattcttcggtttggtgatggctctgattggatccctgctcagtatacttgtggcagtcataatgccggccttgtgcttcttgaagatcgcacagaataaagccacacgcccgcaggtgattgcaagcgtggctataatagtggttggagtcatcagtgctgccctcggaacatactcctcggtggctagcataatcggatactactaattcttccaaagcaatctcttcgacagctctcagtaccgtcactcttggcaagagtttttgctgtgtatcatcgaattttaccgtgctctatgtacatccttcgacctagtatagtcgatttataaagactgcatctctagcaacaatgcactactgttaccatttagctgctgctatatcatttggtgtaccatatttctgccaagccctgcggtttaaatattgcctctttttagggctaaaaccaactttagtaacccgaaatattgtttgttgctattcatttattttttaggggaaacgtcaactttattaatccgaaatattgcctgttgttccgc

SEQ ID NO: 699 - DNA, 1628 bp, Zea mays
gaataatcttctgtgatacaacaaccatgtagccaccgatcctaatgagtcatgcataatagcagacacaggcaacagtgccccgtgagcacatgcaggatcagcagtacgacctccgactccgagctactgctcaccctctcgggctctcggcccgcccgtatgccagtctgtctctggtacactccttcatttcatcgcctagctagctactatatagtacgacctgcctgccttgctcttgccctgtgagcagcggcgtgcgatcgatcgaggcagtcgtagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtcgatggcaacggccatgaccaacttgatccccgccatcaccttcgtcatggcggcatcagtcggcctagagagggtggaggccaggaggccgaggagcctggccaagatcttcggcacggccgtctgcgtgagcggcgccatggccatggctttcttcaagggcccgaagctgctcggcgacggcccgaacgctctccagctcctcctccacgcgggcggcggcggcaggtgggtggccggcgcgctcttcctcgtgggcagcagctcctgctggtcgctctggctcatcctgcaggtgcccatctgcaagtcgtacgtggagccgctggctctgtcggcgtggatgtgcgtcctgtccacgctccagtccgcgctgctcgtctccttcctcctgccggaccccagcgcctggaggatccactcgctcttcgagctctcctgctgcgtcttctcgggcgtgttcgggtccggcgtcacgttctacctgcagtcgtggtgcatctccgtgaggggcccgctctactccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaacaagggcggggtggagccagagcaccactcggacgatctggagaagacgtcatcagcgcggtcggatcccaattcgacggccggcgtcggcagtggcatcgccgagcccctcctggcgggcggcgatccaacggagaagtagatgggattttgctgctcttcaagtgttctgtgcgtgcgcgcgcggtgttttcagggtcggtatgctagtgctactgtaacagtgccgtcccagttttgtcatgtacactagtggcagcttcaaatgactccgtgctgccgatgtgtattatccgcacaattttgttaagcaacgcggcgtccccgtcc

SEQ ID NO: 700 - DNA, 1333 bp, Saccharum officinarum
  misc_feature (925)..(925): n is a, c, g, or t
cgagatcgatcgatcgagccagtaagccaaaacaaccggccgtaacgaacgccaggcgccggcaggctctgcagcagctgcagacgacgccaccgccatggaggagtacaaaccgtgtgcggccatggtggtgacgcagtgcatctacgcggctctagcgctctggtccaaggcggtgttcaccggcggcatgagccccctggtcttcgtcgtctacaggcaggccgttgccaccattgtactcgtccccgtcgtcatcgcggccaacaggaggaagatgaaggagatgatgggccgccttggaatcacaggcttctccttggtcttcgtcgcctctcttgtcggggcgacagtgaaccagtgtttgtactaccaaggggtgaatctgggctcgtcttcgatggcaacggccatgaccaacttgattccggccatcaccttcgtcatggcagcatcagtcgggctagagagggtggacgtgaggaggccgaggagcctggccaagatattcggcacggccgtctgcgtcagcggcgccatggccatggccttcttcaagggcccgaagctgctgctgtgcgacctgcacgcgctcctcctcctccactcgccggcggcggccggcggcaggtgggtgacgggcgcgctcttcctggtgggcagcagctcctgctggtcgctctggctcatcctgcaggtgcccatctgcaagtcgtacgtggacccgctggcgctgtcggcgtggatgtgcctcctgtccacgctgcagtccgcgctgctcgtcgccttcctcctgccggacccgaccgcctgaaggatccactcgctcttcgacctctcctgctgcctcttctcgggggtgttcgggtcaggcgtcacgttctacctgcagtcgtggagcatctcggtgaggggcccgttttantccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacggcaagatggggccgcaagagccagagcagcacccggacgatttggagaagacgtcggcgcggtcggactcgatggccgacgtcggcagtggcatcgccgagcccctcctggccggcggcgatgatccaacggagaagtagaggggattttgctcctcagggttcgttatgctagctactggcgcagcgcagtgccgtcccatttttgtcatgtactagtacacttcagtttcaaatgcccggttggtggagtttgacttg

SEQ ID NO: 701 - DNA, 1432 bp, Saccharum officinarum
cgagatcgatcgatcgagccagtaagccaaaacaaccggccgtaacgaacgccaggcgccggcaggctctgcagcagctgcagacgacgccaccgccatggaggagtacaaaccgtgtgcggccatggtggtgacgcagtgcatctacgcggctctagcgctstggtccaaggcggtgttcaccggcggcatgagccccctggtcttcgtcgtctacaggcaggccgttgccaccattgtactcgtccccgtcgtcatcgcggccaacaggaggaagatgaaggagatgatgggccgccttggaatcacaggcttctccttggtcttcgtcgcctctcttgtcggggcgacagtgaaccagtgtttgtactaccaaggggtgaatctgggctcgtcttcgatggcaacggccatgaccaacttgattccggccatcaccttcgtcatggcagcatcagtcgggctagagagggtggacgtgaggaggccgaggagcctggccaagatattcggcacggccgtctgcgtcagcggcgccatggccatggccttcttcaagggcccgaagctgctgctgtgcgacctgcacgcgctcctyctcctccactcgccggcggcggccggcggcaggtgggtgacgggcgcgctcttcctggtgggcagcagctcctgctggtcgctctggctcatcctgcaggtgcccatctgcaagtcgtacgtggacccgctggcgctgtcggcgtggatgtgcctcctgtccacgctgcagtccgcgctgctcgtcgccttcctcctgccggacccgaccgcctggaggatccactcgctcttcgacctctcctgctgcctcttctcgggggtgttcgggtcaggcgtcacgttctacctgcagtcgtggagcatctcggtgaggggcccgctttaytccgccatgttcaacccgctctgcaccgtgatcaccaccgtgttcgccgccgccgtcctccgcgaagagctgcacgtcggcaggttcgtaatcgtaatgcatgcaaggttcatttcgtacggtgatcgtgcatggagttgtgagtctgtgacatcgatcttttgtggctgaccgatgatcgatcagcttgctgggcgcgatcgccgtcatcgcggggctgtacgtggtgctgtggggcaaagcgggcgacgccaagatggggccgcaagagccagagcagcacccggacgatttggagaagacgtcggcgcggtcggactcgatggccgacgtcggcagtggcatcgccgagcccctcctggccggcggcgatgatccaacggagaagtagaggggattttgctcctcagggttcgwtatgctagctactggcgcagcgcagtgccgtcccatttttgtcatgtactactagcagyttcaaatgcccggttggtggagtttgacttk

SEQ ID NO: 702 - DNA, 1847 bp, Hordeum vulgare; identical to SEQ ID NO: 90

SEQ ID NO: 703 - DNA, 1945 bp, Hordeum vulgare
gagaaggcccgggagtgggtgggtgggagaactccgtctgcacaccacgcgcgctcgcacgaaattctcctcgccgattcaagccttctgctctgctctcttcgtgttcgggttgttgttggccgagcgacagttgggattctgtggaggaggttggaagtactactctaacaaatggggattggggatggctcacctagtgaaacccagcatgcggcacacaaggaaaagagggatgagaccacgccacttctcccactcaaggcggaagaggaagacgggatccatgagttcaatggagcttctttctcgggtgcagttttcaatctgtcgacaaccatcgtgggggctggaattatggccctgccagcaagtatcaagatgctaggcattatccctggtattttgatgatcatccttgtggcattgctcaccgaggcatcgattgacatgatggtcaggtgcagccaccaggccaagattacatcctatggctggctgatgggtgactcttttggtcaatgggggaggattgcgctgcaagcatctgtggtgataaacaacattggtgtcatgattgtatacatgattatcatcggtgatgtgctatcaggaacatctacaactggtgttcatcaccggggtatctttgaggggtggtttgggcctcatttgtggaattctcgtccagttgttctccttgccacaactatttttgtgtttgctccattggtgagctttaagcgattggattcattgagatacacatctgctctgtcagttgctcttgccgtggtttttgttgtcatcactgctggaattgctattctcagactgatagaaggaaccgcggagattcccaaactcttccccgagatacatgaaatcaattccatctgggaactctttacagccgtgccggttcttgtcactgcctatatttgccactacaatgttcacagcatcgataacgagctggaagatagaagtcagactaagccaattgtgcgaacttcactggctttgtgttcaragtgtttatgttgccacaagtttctttgcatatctcctcttttggcgaggctaccctctccgatgtgctcgctaattttgactccgaccttcatattccattcagctctgtcttcaatgatatagtcagagtgagctatgtagtccatgtcatgcttgtcttccctatagtcttctttgcccttaggctcaacctggatggactcctcttccccacctcaaggcacatttctcatgacaaccgaaggtttaccattatcaccgtctcgctccttgttgtgatttatcttgctgccaacttcataccaagcatctgggacgccttccagttcactggtgctacagctgctgtcctgattggtttcatctttcctgccatgatcatactcaggtaatcagcattctgtttgtgtgatgtgtgcctgatgtttgtaggtatccttttggtttacgtgttcgataactttattctgctcatcgtttcttcagggattcttatgggatcgcaaccaagcgcgataaggttttagctgtaaccatgattgtgcttgctgtgctctccaattcagtggccctgtacagtgatgcgatgagcatcttctacaggaaggtggaggcctagtctgctccatgcctccatactccaagggaataagtccaataaacatgcacaattcggaatgattattgagctttagctagtatattgcacagtcaagcaatgtgatttcatggtgtccattaatttttgttttggacacttgaaaggattttgtttgctgcatttgtcttgtaagccggctcagcatctagatgagcaatttgtgattgggtcgcaggtgtttctatttattgccaagaacgagatttttattcttttgggggttatgtacatgttcatattcgatcgtct

SEQ ID NO: 704 - DNA, 2144 bp, Hordeum vulgare
  misc_feature (1543)..(1543): n is a, c, g, or t
  misc_feature (1551)..(1551): n is a, c, g, or t
cacgcgtccggagagagagagagagagagaggcggccttccctccacagcccacaaagttcttctctgcttttgtctggctctggtcgcgtctgctcctttggctttcagatcccggtgagacttctgctggaaaggagagtgaaaaagaaaatgggtgtcgggaacggatcagcagacgtgagccagcagatgtcgcgcaatgaaatacgagatgagactacgccgcttcttccggtcaaggtggaggaggagggattccatgagtttaatggagcttcattctccggggcagttttcaatctctcgacaaccatcgttggtgctggaatcatggcsttgsctgccagcatcaagatgctgggcctcattcctggccttctgatgatcgtctttgtggcattgctcacagaggcgtccattgacatgcttatcaggtgcagccaccaaggaaagatcacgtcatatgggtggctgatgggtgaggcataggrsrrkggggaaggattgcgttgcaggcttctgtggttataaacaacatcggtgtgatgattgtttacatgattatcattggcgatgtattatctggaacgtcatcaggcggtgttcatcatcgtggcatattggagggctggtttggagcacatttgtggaattctcgtgccattgttcttcttgtgacaactctttttgtgtttgctccgttagtgagctttaaacgactggattcattgagctacacatctgcactatcagttgctctcgctgtgatttttgttgttattactgctgggattgccataatcaaagtcttcaatggaactgtagcaatgcccaagctttttccagaaatagacagtcttagttctgtctggaagctttttacagctgtacctgtccttgtcactgcctacatctgccactataacggtatgcagttttattccccagctaatcttgccattattcaattatgtcgattctaaatgcatgttttcatgattccacagttcacagcattgacaatgagcttgaggataaaacacaaactaaaccaattgtgcgaacatcgctggcactttgctccagtgtttacattgccacaagtttctttgcttatcttctctttggagagggtacactggatgatgtgctcgccaactttgattcaaatcttggcattccgttcagctctgtctttaatgacatagtcagagtgagctatgccgcccacgtcatgcttgtcttcccaatcgtcttctttgcccttaggctcaacttggatgggctactctttcccacgtcgaggcacatttctcatgacaataagagatttacaatcataaccatctcactccttgtggttatttatactgctgccatcttcataccaagcatttgggatgcatttcagtttactggtgccacagctgccgtcttgatcggttttatctttcctgcgatggtcatattaaggtacctaaataatgcttctgattggtaatatattccctattttgctaatcgctcccatattaacacantaactcgnattttttcttcaggggatccgtatggaatcgcaaccaagcgcgacaagatcttggctgtaaccatgattgtgcttgctgttgtctcaaactctgttgccctatacagtgacgcaatgaacatcttccgtcggaaagaggtagcctaaatttcagacttcgaagttcaaaggaagggtgtcactgatgaggaagcacagtttcatattacaaaattcagtggctttggaggaagatggtttgctgggatgctgtaaagcaagatgattgcttggtcagcaactcagcattgagacctgtcacatggaagaattggatggttgaaattgtcaggtcttgtgtatataagctggctcaacgtcgaattgagccacttgcaatatatgtatgttctttttttggcgcgaatatatgtgcccaccccagatagaaaagaaagcattgctgcagaaaagcttgctctagaattatgtacagtgttcctagtatttgagttgagttaaatatgtttcattcgaacctaaacttgaggttccgaataaaaatgaagtggccattgttaccatccttttcctctgaggaaacctgtagattg

SEQ ID NO: 705 - DNA, 2749 bp, Zea mays
gttggcctcctcgggagaggccgggaaagggagtgggccaggcaaagtcggctcttgcgtcgacatcgacggggagaaacagctgtgggcaggcgatgaactgtagcgcgtgacagtgaggggatttggttggatccaatgtttggtcggtctgcttgcatcacctggttgcagctctgcatttyctggctataaagcgacggggcccttgcgctgggcgcggagactggagagggcgagagtcctcccatccacaagttcttagcttttgcgagattgagatccggctggggacagaccgacagaggaaggtgaattgtgggaaagaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaattgcgctgcaggcctccgtcatcataaacaatgttggcgtgctaattgtttacatgattatcattggtgatgtattatctggaacaacatcaggcgatgttcatcatcgtggtatattggagggctggtttggagctcatttgtggaattctcgtgccattgttcttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttggatgggttgctcttccccacgtcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttaggtaactcaatgtttagttcttggtgtatgttgcctactactagccaagccattttgtatagcatgtaatatcgtggcttgaatttctgcagggattcttacggaatcgcgagcaagcgcgacaagattctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaggtcttggaaacagccttttccacaataatgtacagttattatgccaatttctgagttcagttaaattttgtgaaatatggacatgggcgtcttgtctcgattaaaattgagaatggtatgattgcacattacgtcgctaaaaaaaaaaaaaccgcctagtgaaccaaattccggttatatttcccggcccgtcctcccacgcgtccgggaatcgcgagcaagcgcgacaagattctggctgtaaccatgatcgtgcttgctgtggtgtcaaattctgtcgccctatacagtgacgcgatgaacatcttccgtaagaaggaagtggcctgatctcagatttcaaaagtagtcagtgctggatgaagaatggtctcgcaatgcaagactcgatggtacaaggaaaacgatgcgcttggattccgtgaaggaacgatttctttgtcagcaactcagaatttggccaattgaaagaatctgatgcttgaagtttcctggttctgtgtacacaagtcggctcaatgtcagaattgagccgcttgaaatatatatatttatattctatgcggagagtaggtcttggaaacagccttttccacaataatgtacagttattatgccaatttatgagttcagttaaattttgtgcaatcacaccattcttaattttaatcgagacaagacgccccatgtccatat

SEQ ID NO: 706 - DNA, 1830 bp, Oryza sativa
gtgagcttctgtaggtgtgatattctcttttgatcttatctgatcgccggtattgagcaaggattggggtttggggtaaggatagcgaacacaaatgggaattgggaatggatcaccaagtgacagcaggcatgtgtcacacaaggaaatacgagatgagaccacaccgcttctcccaattaaggaagaggaggaggggatccatgagttcaatggagcttctttctccggtgcagtgttcaatctgtcaacgaccatcgtgggggctggaattatggcactgccagcgagcatcaagatgctgggaattatccctggtatcctgatgatcatccttgtggcgttgctcactgaggcatccattgacatgctggtcaggtgcagccacgagggcaagattacgtcctacgggtggctgatgggtgaaactttcggtcagtgggggaggatcgcgctgcaagcatctgttgtaataaacaacattggcatgatgatcgtttacatgattatcgttggtgatgtgctgtccggaacatcaacaagtggtgttcatcaccgtggcatcttcgaggggtggtttggacctcatttgtggaattctcgtccggttgttctccttgctacgactctttttgtgtttggtccattggtgagctttaagcgtttggattcattgagatacacatctgcactgtcagttgctcttgctgtggtttttgttgtcatcactgctggaattgcgattgtcagactcattgaaggaactgtggagattcccaaactctttcccgagttagatggaactaattccatctgggaactctttacagctgtgcctgttgttgtcactgcctacatttgccactacaatgtacatagcatcgacaatgagttggaagatagaactcaaaccaagccaattgtgcaaacttcactggctctctgctcaagtgtgtacattgcgacaagcttctttgcatatctcctctttggcgagggtaccctggctgatgtactcgccaactttgactccaaccttcatattccattcagctctgtcttcaatgatgttgtgagagtgagctatgtagtccacatcatgctcgtctttcccatagtcttcttcgcccttaggctcaatttggatggactgctcttccctactgcaaggcacatttctcgtgacaacagaaggttcgccattatcacgggatcactccttgctgtaatttatcttgctgccatcttcataccgagcatctgggacgcgttccaattcaccggtgccacagctgctgttcttatcggttttatctttcctgccatgatcatactcagagatccttatggaattgcaaccaagcgcgacaagattttggccttaaccatgattgtgcttgcggtgctctcaaattctgtggctctatacagcgatgcactgaacatcatctttcacaggaaagtggaggcctaaaactccatacttcgagcgacaaagtggaatgtacagttagaatgatttggtgagtttaaattagtaatacccagcaaagcaatgtgattttcggtggtagccattgatttttattctggacacctgaaaggatttgatttgctgcatttgtctagtttcctgaacataagctggttcaacatttagaagagccacttgtgaattgtgatatggttgcggttgtttgtatctattccgccaaaaagaatttttctttttgttctatacatgtttattcaatcatcctgaaaattttaagtggatgacttgaaaaggttgtttatatatacaataatgcacattgaaactaaaaaaag

SEQ ID NO: 707 - DNA, 1924 bp, Oryza sativa
agaagagagaggcttttgctctgctgatccacccggcgttggttcgcctataaaaaaagagaggagtttgggggaggaagagagagcttctgtaggtgtgatattctcttttgatcttatctgatcgccggtattgagcaaggattggggtttggggtaaggatagcgaacacaaatgggaattgggaatggatcaccaagtgacagcaggcatgtgtcacacaaggaaatacgagatgagaccacaccgcttctcccaattaaggaagaggaggaggggatccatgagttcaatggagcttctttctccggtgcagtgttcaatctgtcaacgaccatcgtgggggctggaattatggcactgccagcgagcatcaagatgctgggaattatccctggtatcctgatgatcatccttgtggcgttgctcactgaggcatccattgacatgctggtcaggtgcagccacgagggcaagattacgtcctacgggtggctgatgggtgaaactttcggtcagtgggggaggatcgcgctgcaagcatctgttgtaataaacaacattggcatgatgatcgtttacatgattatcgttggtgatgtgctgtccggaacatcaacaagtggtgttcatcaccgtggcatcttcgaggggtggtttggacctcatttgtggaattctcgtccggttgttctccttgctacgactctttttgtgtttggtccattggtgagctttaagcgtttggattcattgagatacacatctgcactgtcagttgctcttgctgtggtttttgttgtcatcactgctggaattgcgattgtcagactcattgaaggaactgtggagattcccaaactctttcccgagttagatggaactaattccatctgggaactctttacagctgtgcctgttgttgtcactgcctacatttgccactacaatgtacatagcatcgacaatgagttggaagatagaactcaaaccaagccaattgtgcaaacttcactggctctctgctcaagtgtgtacattgcgacaagcttctttgcatatctcctctttggcgagggtaccctggctgatgtactcgccaactttgactccaaccttcatattccattcagctctgtcttcaatgatgttgtgagagtgagctatgtagtccacatcatgctcgtctttcccatagtcttcttcgcccttaggctcaatttggatggactgctcttccctactgcaaggcacatttctcgtgacaacagaaggttcgccattatcacgggatcactccttgctgtaatttatcttgctgccatcttcataccgagcatctgggacgcgttccaattcaccggtgccacagctgctgttcttatcggttttatctttcctgccatgatcatactcagagatccttatggaattgcaaccaagcgcgacaagattttggccttaaccatgattgtgcttgcggtgctctcaaattctgtggctctatacagcgatgcactgaacatcatctttcacaggaaagtggaggcctaaaactccatacttcgagcgacaaagtggaatgtacagttagaatgatttggtgagtttaaattagtaatacccagcaaagcaatgtgattttcggtggtagccattgatttttattctggacacctgaaaggatttgatttgctgcatttgtctagtttcctgaacataagctggttcaacatttagaagagccacttgtgaattgtgatatggttgcggttgtttgtatctattccgccaaaaagaatttttctttttgttctatacatgtttattcaatcatcctgaaaattttaagtggatgacttgaaaaggttgtttatatatacaataatgcacattgaaacttgggttgctgttttgtgttac

SEQ ID NO: 708 - DNA, 2088 bp, Oryza sativa
tggggggcaaggaggagtactgtagcttgtgaaagcgagtggttttggatccaagctggttgattgattgctcttcgtctcccctggctataaaacgagcggggccgcagccgggctgcggcgaggccgccctccacagatttcttggcgatttgtctggttctgcctgctcttgctggtttcagatccgggaggggactgagcctccgaagttatcaggagagtgaaagacataatggggatcagcagcgaatcgccgaatgggagccagcagattgtacaaaaggaaacacgagatgagacaacaccacttctgccggtcaaggtggaggaggaggggtttcatgagttcaatggagcttcattttccggggcggttttcaatttatcgaccactattgttggggctggaattatggccttgccagccagtatcaagatgttgggcatcatcccagggattctgatgatcatcgttgtggcgttgctcacagaggcatcaattgacatgcttgtcaggtgcagccaccagggcaagattacatcttatggttggctaatgggtgaggcttacggacagtggggaagaattgcactgcaggcctctgtcgtcataaacaacattggcgtgatgattgtttacatgattatcattggtgatgtattatctggaacatcatcaaccggtgttcaccatcgtggtatacttgagggctggtttggagctcatctctggaattcacgtgccattgttcttcttgcgacgactcttttcgtgtttgctccattggtgagctttaagcgtctggattcattgagatacacctctgccctatcggttgctcttgctgtggtttttgtcgtcattaccgctggaattgctatcatcaaactcttcaatggaactgtagcgatgcccaaactttttccagaactagatggtcttagttccatctggaagctcttcacagctgtccctgttcttgtcactgcctacatctgccattacaatgttcacagcattgacaatgagcttgaagacagaacacaaattaaacctattgtgcgaacatccctgttcctctgctccagtgtttacattgctacaagtttctttgcatatctcctcttcggcgagggtaccctagatgatgttctcgctaacttcgatgcaaatcttgggattccatttagttccgtctttgatgatatagtgcgagtgagctatgctgctcacgttatgctcgtctttcccatagtcttctttgcccttaggctcaacttggatggactgctcttccccacatcaaggcacatttctcgtgacaacaagagatttgccataatcactatctcactcctcacagtaatttatcttgctgccattttcataccgagcatttgggatgcattccagtttactggtgcaactgctgctgtcctgattggtttcatcttccctgccatggttatacttagggatccttatggaatcgcatccaagtgtgacaagatcttggctgtaaccatgatcgtgcttgctgtcctctccaattctgttgctttatacagcgatgcaatgaatatcttccgtaaggaagaggaggcatgaatgtcagactccaaaggaatgtcatcaaatatcagtgatgaaggaagcgtggcttcatgttatgagacacagatgctgtgaagggaaattatttcctggaatccagcaaacgaagatttcttggtcagcggtcgaggttccagtcactcgaatgaattggatggttgaatctgcgtggcttctgtgcgaaccggctcaaattcgaattgagctgctcgcgatatctgtattgttagtgttcttgtatccacaagcaatgtatggctttaaaatgcctggtttacaataatgtacagtttcaaaaatacttcagatgagttaaatgtctatgtgaacctggactcactgtcgatttaaaattggaatggctgttgttgccatctttaattcacttgtgtgtcaagtctctgcatgtttgaattaaggcaatatgagaatttaatttacttttgaaaaactctggtttccaatgatgt

SEQ ID NO: 709 - DNA, 2399 bp, Oryza sativa
gggcgcggttaggcgccgccatcgatcgaagcagcaagcgaggaaaaacagccaagagagaggaacatcaagacggcaagaaagcagcaacaggaccagagcaagcaagaccccatcaatcaatcatcggataccacctctcgctgccctgcgccccccacaagattccgacgacagcaaagacagcgacgggaggggagggatcgcgcgttctcgattcggaaatattttttttgttccctctcttgccgttgatgtcgacggaaatcacagtgtggaggtgggggcaaggagaagtactgtagcttgtgaaagcgagtggttttggatccaagctggttgattgattgctcttcgtctcccctggctataaaacgagcggggccgcagccgggctgcggcgaggccgccctccacagatttcttggcgatttgtctggttctgcctgctcttgctggtttcagatccgggaggggactgagcctccgaagttatcaggagagtgaaagacataatggggatcagcagcgaatcgccgaatgggagccagcagattgtacaaaaggaaacacgagatgagacaacaccacttctgccggtcaaggtggaggaggaggggtttcatgagttcaatggagcttcattttccggggcggttttcaatttatcgaccactattgttggggctggaattatggccttgccagccagtatcaagatgttgggcatcatcccagggattctgatgatcatcgttgtggcgttgctcacagaggcatcaattgacatgcttgtcaggtgcagccaccagggcaagattacatcttatggttggctaatgggtgaggcttacggacagtggggaagaattgcactgcaggcctctgtcgtcataaacaacattggcgtgatgattgtttacatgattatcattggtgatgtattatctggaacatcatcaaccggtgttcaccatcgtggtatacttgagggctggtttggagctcatctctggaattcacgtgccattgttcttcttgcgacgactcttttcgtgtttgctccattggtgagctttaagcgtctggattcattgagatacacctctgccctatcggttgctcttgctgtggtttttgtcgtcattactgctggaattgctatcatcaaactcttcaatggaactgtagcgatgcccaaactttttccagaactagatggtcttagttccatctggaagctcttcacagctgtccctgttcttgtcactgcctacatctgccattacaatgttcacagcattgacaatgagcttgaagacagaacacaaattaaacctattgtgcgaacatccctgttcctctgctccagtgtttacattgctacaagtttctttgcatatctcctcttcggcgagggtaccctagatgatgttctcgctaacttcgatgcaaatcttgggattccatttagttccgtctttgatgatatagtgcgagtgagctatgctgctcacgttatgcttgtctttcccatagtcttctttgcccttaggctcaacttggatggactgctcttccccacatcaaggcacatttctcgtgacaacaagagatttgccataatcactatctcactcctcacagtaatttatcttgctgccattttcataccgagcatttgggatgcattccagtttactggtgcaactgctgctgtcctgattggtttcatcttccctgccatggttatacttagggatccttatggaatcgcatccaagcgtgacaagatcttggctgtaaccatgatcgtgcttgctgtcctctccaattctgttgctttatacagcgatgcaatgaatatcttccgtaaggaagaggaggcatgaatgtcagactccaaaggaatgtcatcaaatatcagtgatgaaggaagcgtggcttcatgttatgagacacagatgctgtgaagggaaattatttcctggaatccagcgaacgaagatttcttggtcagcggtcgaggttccagtcactcgaatgaattggatggttgaatctgcgtggcttctgtgcgaaccggctcaaattcgaattgagctgctcgcgatatctgtattgttagtgttcttgtatccacaagcaatgtatggctttaaaatgcctggtttacaataatgtacagtttcaaaaatacttcagatgagttaaatgtctatgtgaacctggactcagtgtcgatttaaaattggaatggctgttgttgccatctttcggactttcacttgtgtgtcaagtctctgcatgtttgaattaaggcaatatgagaatttaatttacttttgaaaaactctggtttccaatgatgttgaaaagtacaatgctaaattttcatc

SEQ ID NO: 710 - DNA, 1883 bp, Sorghum bicolor
tgttggcctctggagcytcctckctgtgcagtacaagttgtcctctctttggtttagtttagtttgcgctgctggatttgttcaggcttttggtcttgagttgaggaaaaaagatttggggttcttgaaaggaaatcacatcggagttgatcatctaatgtagaactagtcaaggaataatggtgagtgaaacaaatgggtattgggaatggatcatcaagcaatgtgtcgcacaaagcgatgcaagatgagaccacgccgcttctcccgatcaaagctgaggaggacgtggttcacgagttcgatggagcttctttctctggtgcagtcttcaatctgtcgacgaccattgtaggggctggaatcatggctctgcctgcgagtatcaagatgctaggccttatccctggtattctaatgatcatccttgtggcgttgctcaccgaggcatccattgacatgctggtcaggtgcagccaccagggcaagattacatcctacgggtggttgatgggtgacacttttggtcagtgggggagaattgccctacaagcatcagtggtgataaacaatgtcggcgtattgattgtatacatgattattattggcgatgtcctatcaggaacatcatcaacaggtgttcatcacagtggtgtatttgaggggtggtttggacctcatatgtggaattctcgtcccattgtactcctcactacaactcttgttgtatttgctccattggtgagctttaagcgtctggattcattgagatacacatctgcactatcagttgctcttgctgtggtttttgttgtaatcactgctggggttgctattgtcagactcatccaaggaactgtggagatccccaaactctttcctgagatagatggagttagttctgtctggaaactgtttacagctgtgcctgttcttgtcactgcctacatctgccactacaatgttcacagcattgataatgagctggaggacaagacccaaattaaaccaattgtacaaacttcactgggactctgctcaagtgtttacattgcaacaagcttctttgcatatctcctcttcggcgaggctaccttggctgatgtgcttgccaatttcgattctgaccttcgcattccattcagctctgtcttcaatgacatagtgagagtgagctatgttgtccatatcatgcttgtctttcctatagtcttctttgcccttaggctcaacctggatggattactctttcccaccgcaaggcacatttcccatgacaacaagaggttcaccattatcaccatctcgctcattgctgtaatttatcttgctgctatcttcgtaccgagcatctgggatgcgttccaattcactggcgccacagctgctgtgcttattggtttcatctttcctgccatgattatactcagggatccatatggtgtttccaccaagcgtgacaaggttttggcggtaacaatgattgtgcttgctgtggtgtccaattctgtggccctgtacagcgatgcgctcaacatcttctacaggaagcaggaggcctagagtccatcatacctcaggggaaaagttctttatacaggtctagagtgattgttgacctttttaagctactactgagcagcagtgccacgagatttcatggtggtcaatattttttgtttggtcacttgaaagaaacctggtttgttgcaaatatttgttagtcttctgaacataaaccgcctccacatctggatggcccacttgtgctatgatcacctgtggaacattttttttttcacgtggttgttcattcagtcatcttgtaatggatgactaaaaatgctgtatatatataacggatagttccctgcttttgtgtt

SEQ ID NO: 711 - DNA, 1832 bp, Sorghum bicolor; identical to SEQ ID NO: 88

SEQ ID NO: 712 - DNA, 1902 bp, Saccharum officinarum
cccacgcgtccggcaagtacaagttgtcctctctttggtttagtttagtttgcgctgctggatttgttcagggttttggtcttgtgttgaggaaagaattggggttcttgaaaggtgagtgaaacaaatgggtattgggaacggatcatcaagcaatgtgtcgcacaaagcgatgcaagatgagaccacgccgcttctccctatcaaagctgaggaggacgcagttcatgagttcaatggagcttccttctctggtgcggtcttcaatctgtcgacgaccattgtaggggccggaatcatggctctgcctgcgagtatcaagatgctaggccttatacccggtattctaatgatcatccttgtggcgttgctcactgaggcatccattgacatgctggtcaggtgcagccaccagggcaagattacatcctacgggtggttgatgggtgacacttttggtcagtgggggagaattgcgctacaaggatctgtggtgataaacaatgtcggtgtgttgattgtatacatgattattattggcgatgtcctatcgggaacatcatcaacaggtgttcatcacagtggcgtatttgaggggtggtttggaccgcatatgtggaattctcgtcccattgtacttctcgctacaactcttcttgtgtttgctccattggtgagctttaagcgtttggattcattgagatacacatctgcactatcagttgctcttgctgtggtttttgttgtcatcactgctggggttgctattgtcagactcatccaaggaactgtggagatccccaaactctttcctgagatagatggagttagttccatctggaaactgttcacagctgtgcctgttcttgtcactgcctacatctgccactacaatgttcacagcattgataatgagctggaggacaagactcaaattaaaccaattgtacaaacctcactgggactctgctcaagtgtttacattgcaacaagcttcttcgcatatctcctctttggcgaggctaccctggctgatgtgcttgccaactttgactctgaccttcgcattccattcagctctgtcttcaatgacatagtgagagtgagctatgttgtccatatcatgcttgtctttcctatagtcttctttgcccttaggctcaacttggatggactactctttcccaccgcaaggcacatttcccatgacaacaagaggttcaccattatcaccatctcactcgttgctgtaatttatcttgctgccatcttcatacctagcatctgggatgcattccaattcactggcgccacagctgctgtgcttatcggtttcatctttcccgccatgattatactcagggatccatatggtgtttcaaccaagcgtgacaaggttttggcggtaacaatgattgtgcttgctgtggtgtccaattctgtggccctgtacagcgatgcgctcagcatcttctacaggaaacaggacgcctagatagagtccatacctcaggggaaagaaaagttctttgtacaggtctagagtgattgttgagctttaagctactactgagcagcgtgccactagatttcatggtggtcaatattttttgtttggtcacttgaaagaaacttggtttgctgcgaatatttgatagtcttccgaacataaaccgcctccagatctagacgggccacttgtgctatggtcacccgtggaacattttttgttttttccgtggttgttcatccagtcatctcgtaatggatgactgaaaagtctgtatatatgcaatgactagcaaatatgtccgtgcgttgcaacgagagtttgttgcatggtcacttagaccatatgtggctagaagatttattcaatgatcacgtcatgtgtttgaattc

SEQ ID NO: 713 - DNA, 2134 bp, Saccharum officinarum
  misc_feature (2125)..(2125): n is a, c, g, or t
  misc_feature (2127)..(2127): n is a, c, g, or t
  misc_feature (2134)..(2134): n is a, c, g, or t
tccaatcacctgacaccacctcgccctcgcgagattcctaggggagggggccaggccaagtcggctcttgcgtcgacatcgacggggagaatcagctgtgggcaggcgatgaactgtagcgcgtgacagcgagagggtttgattggatccattgtctggccgttctgcgtgcatcacctgattgcagctctgcatttcctggctataaagcgacggggcccttgtccaggccgcggggactggagagggaaagagtcctcccatccacaagtctttagcttttccgcgattgagatccggcagggttacagaggaagctgaattgtggaaaggagtgacagaaaaatggggattggagatggatcttcaaatgggaaccagcaaccggtgcataaggaaatacgagatgagacaacgccacttcttccagtcaaggtggaggaggatgaggggtttcatgagttcaatggcgcttcattctctggggcggttttcaatctgtcgaccaccatagttggggctggaattatggctctgccagcaagtatcaagatgctgggcatcatcccagggattctgttgatcatcattgtggcactgctcacagaggcatccatcgacatgcttgtcaggtgcagccaccagggcaagattacgtcatatgggtggctgatgggagaggttttcggacagtgggggagaattgcgctgcagggctctgtcatcataaacaacgtcggcgtgctaattgtttatatgattatcattggtgatgtattatctggaacaacatcaggcgatgttcatcatcgtggtatattggagggctggtttggagctcatttgtggaattctcgtcccattgttcttcttgccacagctcttttggtgtttgctccattggtgagctttaagcgtttggattcattgagatacacatctgcactatcagttgccctggcagtagtttttgttgtaattactgctgggattgccatcatcaagctcttcaatggaactgtagcgatgcccaaactttttccagaattggatggtcttaattctatctggaatctttttacagctgtccctgttcttgttacggcctacatctgccactataacgttcacagcattgacaatgaacttgaagacagaacacagatcaaaccgattgtgcgaacatcgctgttcctgtgctccagtgtttacattaccacaagtttctttgcctatctcctctttggtgagggcacactggatgacgtgcttgccaactttgacgcaaatcttggcattccattcagttcagtctttgatgacatagtgcgagtgagctacgccgcgcatgtcatgcttgtctttcccattgtcttctttgcccttcggctcaacttggatgggttgctcttcccaacatcaaggcacatttctcgtgacaataagagatttgccatcatcaccatctctctcctcacagtaatttatcttgctgccattctcataccaagcatttgggacgcattccagtttactggtgccacagctgccgtcctaattggtttcatatttcctgccatggtcatacttagggattcttatggaatcgcaaccaagcgtgacaagattctggctgtaaccatgatcgtgcttgctgttctgtcaaattctgttgccctatacagtgacgcgatgaacatcttttgtaagaaggaagtggcctgaacttcagatttgaaaagtagtcagtgatggatgaagaatggtctcgtaatgcaaaactcgatgagaccaaggaagatgatgcacttggattctgtgaaggaatgttttctttatcagcacctcagaatttggccacttgaaagaatctgatgattgaagtttcctggtcttgtgtacacaaatcggctcagtgagaattgagccgcttgaaatatatgtatgtatattctatgcggagagtaagtcttggaaaaagctttctccacaataatgtacagttatgccaatttctgagtttagttaaattttgtgaaatgtggacatgggtgtcttgtgttgaatgattcagaatgatatgattacatacgtcgctaccatatctgtttttgcctttcaaaananaaaaaan

SEQ ID NO: 714 - DNA, 2177 bp, Triticum sp.
ccgcacgcctcgccgttttttgtcatctcgccgacgccgcggataaggaatggcgaggcagcaagcaaccggccaaagactaaactaatctggcaagtaagaggaagcaaagatcgactgcggaaggcaaggcagggacgcaatccggagggrattaattgctttccttcctyccttwmcgtggaaagggaccggcgctcgcggcgaccaggaaggcaaggaacgcgtccggttcttggataagcggaggcgcggcaccgcaccgcacgcggcattcgccaatataagaaggccgccgggggtgggaggcggagggacaactccgtctacacagcgcgcgcgcacccgccaaagtcttctcccgcgattttcttcgtctccgctctcttcgtgttcgggttgttggccgagcgactgttgggattctgtagaggaggttgaaagtacttgaaacaaatggggattggggatgcatcacctagtgaaaaccagtctgcacacaaggaaaagagggatgagaccacgccacttctcccgstcaaggcggaagaggaagatgggatccatgagttcaatggagcgtctttctcgggtgcagttttcaatctgtcgacaaccatygtgggggctggaattatggccctgccwgcaagtatcaagatgctaggcattatccctggtattttgatgatcatccttgtggcattgctcactgaggcatcaattgacatgatggtcaggtgcagccaccaggccaagattacatcctatggctggctgatgggtgactcttttggtcaatgggggaggattgcgctgcaagcatctgtggtcataaacaacattggcgtcatgattgtatacatgattatcatcggtgatgtgctatcgggaacatctacaactggtgttcatcaccggggtatctttgaggggtggtttggtcctcatttgtggaattctcgtccagttgttctccttgccacaactatttttgtgtttgctccattggtgagctttaagcgattggattcattgagatacacatctgctctgtcagttgcycttgctgtggtttttgttgtcatcactgctggaattgctattctcagactgatagaagggaccgcggagattcccaaactcttccctgagatacatgaaatcaattccatctgggaactctttacagctgtgccggttcttgtcactgcctacatttgccactacaatgttcacagcattgataacgagctggaagatagaagtcagactaagccaattgtgcgaacttcattggctctctgttcaagtgtttatgttgcaacaagcttctttgcatatttactcttcggcgagggtaccctctccgatgtgctcgctaattttgactctgaccttcatattccattcagctctgtcttcaatgatatagtcagagtgagctatgtagtccatgtcatgctggtcttccctatagtcttctttgcccttaggctcaacctggatggactcctcttccccacctcaaggcacatttctcatgacaaccgaaggtttatcattatcaccgtctcactcctcgctgtgatttatcttgctgccaacttcataccaagcatctgggatgcgttccagttcaccggtgctacagctgctgtcctgattggtttcatctttcctgccatgatcatactgagggattcttatgggattgcaaccaagcgcgacaaggttttagctgtaaccatgattgtgcttgctgtgctctccaattcagtggccctgtacagcgatgcgatgagcatcttctacaggaaggtggaggcctagtctgctccatgcctccatactccaagggaataagtccaatgcacatgcacaattcggagtgattattgagctttagttagtatattgcgcagtcaagcaatgtgatttcatggtggccactaatttttgttttggacacttgagaggattttgtttgctgcatttgtctagttccttgaacatgtaatccggctcagcatctagatgagcaatttgtgatctggtcgcaggtgtttgtatttattggcaagaacaagatttttatttacttttgggggtcatgtacatgttmatattcgatcatcttgaaatggatgtttgagaaagctctttatatgcaaata

SEQ ID NO: 715 - DNA, 1974 bp, Triticum sp.
ccacgcgtccggcctggtggctcagagmsasgcgkccskckcyccctccctccrcagtccacaagttcttctctgcttttgtctggctctggtcgcgtctgctcttttggctttcggatcccggagagacttctgctggtggaaaggagagtgaaagagaaaaatgggtgtcgggaacggatcagcggacgtgaaccagcagacggcgcgcaacgaaatacgagatgagactacgccgcttcttccggtcaaggtggaggaggagggattccatgagtttaatggagcttcattctccggggcagttttcaatctctcgaccaccatcgttggtgctggaatcatggccttgccagccagcatcaagatgctgggcctcatccctggccttctgatgatcatctttgtggcactgctcacagaggcatccatagacatgcttatcaggtgcagccaccaaggaaagatcacgtcatatgggtggctgatgggtgaggcatatggacaatgggggaggattgcgctgcaggcctctgtggttataaacaacatcggtgtgatgattgtttacatgattatcattggtgatgtattatctggaacatcgtcaggcggtattcatcatcgtggcatattggagggctggtttggagcacatttgtggaattctcgcgccattgttcttcttgtgacaactcttttcgtgtttgctccattggtgagctttaaacgattggattcactgagctacacatctgccctatcagttgctctcgctgtggtttttgttgttattactgctgggattgccataatcaaagtcatcaatggaactgtagcaatgcccaagctttttccagaaatagatgatcttagttctgtctggaagctttttacggctgtccctgtccttgtcactgcatatatctgccactataatgttcacagcattgacaatgagcttgaggataaaacacaaactaaaccaattgtgcgaacatcactggccctttgctccagtgtttacattgccacaagtttctttgcttatcttctctttggagatggtacactggatgatgtgctcgccaactttgattcaaatctcggcattcctttcagctctgtcttcaatgacgtagtcagagtgagctatgctgcgcacgtcatgcttgtcttccccatcgtcttctttgcccttaggctcaacttggatgggctactctttcccacgtcgaggcacatttcttatgacaataagagatttacaatcataaccatctcgctcctcgtggttatttatactgctgccatcttcataccaagcatttgggatgcattccagtttactggtgccacagctgccgttttgattggttttatctttcctgccatggtcatattaagggatccttatggaatcgcaaccaagcgtgacaagatcttggctgtaaccatgatcgtgcttgctgttgtctcaaactctgttgccctatacagtgatgcgatgaacatcttccgtaggaaagaggtagcctgaacttcagagttcaaagttgaaaggaagggtgtcactgatgtaggaagcgcagtttcatattacaaaattcagtggctttgaaggaagatggtttgctgggatgctgtgaagaaagatgatttctttggtcagcaactcagcattgaggcctgccacatggaagaattggatggttgaaattgtcaggtcttgtgtacatgagctggctcaacgtcgaattgagccacttgcaatatatgtatgttctttttttggcgcgaatatatgtgcccaccccagacagaaaagaaagcattgctgcaaaaagcttgctctacaataatgtacagtgttcctagtatttgagttgagttaattctatgttttatttggacctaaatccaaggtttcgaatacaaataaagtggccattgttaccatccaaaaaaaaaaaa

SEQ ID NO: 716 - DNA, 2055 bp, Hordeum vulgare
gaccacagccgctcctttctcatcggtttcccccgtcgcgagatcgcccgttttctctcaacgcttccgaccggagaggaagaggaatacaaatcccatcgaattcgcctggtcgcggtttcatcatcttctgtccctgtgtgtgtgtgtgtgtgctggtggtggtggtcttgatccgttgttaatttcgattcaatcgcccggacgccatgggattggggagcgacgcgagctcgtcgtcgtcgcggctggactcggcgccgctgctgccgcaccacagcgccgaagggggccacctgtcgtcgcagcccaagacgttcgcgaacgtcttcatcgcggtggtcggcgccggcgtgctcggcctgccctacacgttctcgcgcaccggctgggcggcgggctccatcctgctcctctccgtcgcgctgctcaccttctactgcatgatgctgctcgtcgcctgccgccgccgcctcgccgacgagcaccccaagaagctgtcctcgttcggggatctgggggacgccgtcttcggcgcgcccggccgcctcgccgtggacaccatgcttgtgctcagccaggccagcttctgcgtcggatacctgatctttatctccaacaccatggcgcacctctaccccatcttcgccccctcctccaacgtcttcctctcccctaaggcgctcttcatctacgccatgctgccgttccagctcgggctcaactccatcaagacgctcacgctcctcgcgccgctcagcatcttcgccgacgtcgtcgacctcggcgccatgggggtcgttgttggacaggacgtgtcgacctggctcgccgcacatccacccgtcgtcgcgttcggcgcccccgccgcgctcctctacggcgtgggcgtgtccgtgtacgccttcgagggcgtctgtatggtcctgccgctggaggcggaggccgcggacaagaagaagttcggcgccacgctcgggctgtccatggcgttcatcgccgccatgtacgggctgttcggtgtcatggggtacgtcgcgttcggcgacgccacgcgcgacatcatcaccaccaacctcggcagcgggtggctgtcggccgccgtgcagctggggctgtgcatcaacctcttcttcaccatgccggtgatgatgaacccagtgtacgaggtcgccgagcgcctgtttcacggcaagcgctactgttggtggctgcggtgtgtgctcgtggtcaccgtggggctcgcggccatgctygtgcccaatttcaccgacttcctcgccctcgtggggagcagcgtctgcgtgctgctcgggttcgtgctgccggccaccttccacatgaaggtgttcggagccgagatgggctgggccggggttctcagcgacgtcctcctggtcgtgctcggcctcgtgctctccgtcttcggcacctactcgtcgctggtgcaaatcttccactcttccagcgcttaatttccggtattcgccgagggttaaattgctgggtgcattggctctctcatccacgccggttaagctcccgcgtagtagttttccacactacgagaaggggatcagcggatcagagaggaattgcttggctcagctatttgttgatctgggaaatggattgttgggaattctgttcagattgttagtacgagatactactagttgattggaggcatggagaaatctgtatggttttgctacgacagtttccatcatgtctgcccatagcattcttytactctgttcatgtcctagatgttccagctgcagtgcgtgatggaattgatgaaaggacacgaatttcagtattttgttacttgtcccgtagtgtcagcgtgcaatattgtgtcttgtgtatgtgcttaattgggctgggcaagcaattgggacgacttacattgcttgtcaaagcatgattacatgatactcctactaccattgtatacgtttcgaactgttgttctagtatgtcccaagcaagcaacccaagcttgtaaagggtcctgaaggaataaaattggaactatgaatcatttttatt

SEQ ID NO: 717 - DNA, 1788 bp, Hordeum vulgare
cgtcgcgagatcgcccgttttctctcaacgcttccgaccggagaggaagaggaatacaaatcccatcgaattcgcctggtcgcggtttcaccatcttctgtccctgtgtgtgtgtgtgtgctggtggtggtggtcttgatccgttgttaatttcgattcaatcgcccggacgccatgggattggggagcgacgcgagctcgtcgtcgtcgcggctggactcggcgccgctgctgccgcaccacagcgccgaagggggccacctgtcgtcgcagcccaagacgttcgcgaacgtcttcatcgcggtggtcggcgccggcgtgctcggcctgccctacacgttctcgcgcaccggctgggcggcgggctccatcctgctcctctccgtcgcgctgctcaccttctactgcatgatgctgctcgtcgcctgccgccgccgcctcgccgacgagcaccccaagaagctgtcctcgttcggggatctgggggacgccgtcttcggcgcgcccggccgcctcgccgtggacaccatgcttgtgctcagccaggccagcttctgcgtcggatacctgatctttatctccaacaccatggcgcacctctaccccatcttcgccccctcctccaacgtcttcctctcccctaaggcgctcttcatctacgccatgctgccgttccagctcgggctcaactccatcaagacgctcacgctcctcgcgccgctcagcatcttcgccgacgtcgtcgacctcggcgccatgggggtcgttgttggacaggacgtgtcgacctggctcgccgcacatccacccgtcgtcgcgttcggcgcccccgccgcgctcctctacggcgtgggcgtgtccgtgtacgccttcgagggcgtctgtatggtcctgccgctggaggcggaggccgcggacaagaagaagttcggcgccacgctcgggctgtccatggcgttcatcgccgccatgtacgggctgttcggtgtcatggggtacgtcgcgttcggcgacgccacgcgcgacatcatcaccaccaacctcggcagcgggtggctgtcggccgccgtgcagctggggctgtgcatcaacctcttcttcaccatgccggtgatgatgaacccagtgtacgaggtcgccgagcgcctgtttcacggcaagcgctactgttggtggctgcggtgtgtgctcgtggtcaccgtggggctcgcggccatgcttgtgcccaatttcaccgacttcctcgccctcgtggggagcagcgtctgcgtgctgctcgggttcgtgctgccggccaccttccacatgaaggtgttcggagccgagatgggctgggccggggttctcagcgacgtcctcctggtcgtgctcggcctcgtgctctccgtcttcggcacctactcgtcgctggtgcaaatcttccactcttccagcgcttaatttccggtattcgccgagggttaaattgctgggtgcattggctctctcatccacgccggttaagctcccgcgtagtagttttccacactacgagaaggggatcagcggatcagagaggaattgcttggctcagctatttgttgatctgggaaatggattgttgggaattctgttcagattgttagtacgagatactactagttgattggaggcatggagaaatctgtatggttttgctacgacagtttccatcatgtctgcccatagcattcttctactctgttcatgtcctagatgttccagctgcagtgcgtgatggaattgatgaaaggacacgaatttcagtat

SEQ ID NO: 718 - DNA, 2199 bp, Zea mays
gcaccccccattcgaacgccggagctcgacaaggacgaccgacgacgcacgcggagatccggcgtactgcaaattttgaaaactgaactgtaagatggcatcagcagagctttcccgtgaggaaaatgtgtacatgttccccaggcgcagcagcacggcagtcctccgtttcctcctcgtcgctcgccccggttgtctcctcctcgacctcccccgtcgcgacaccgcccgatctctctagcgcacggcggacggagaagaggaggagggggggacgatctcattcatcggaccggcgtgcctgtgtcgtctgctgttttcgttattttttctttactctttttttttcttcctcctttgcttgttcaattcaatcagtataataagatttctgatttgggggcggctcgccatgggattcggaatggggaataataacaacggggcgagctcctcgtcgtcgaggctggacccggcggcgccgctgctgccgcgccacggcagcagcgggggccgcgagggtggtggcctgtcgtcgcagcccaagacgttcgccaacgtcttcatcgcggtggtcggcgccggcgtgctggggctgccgtacaccttctcgcgcaccgggtgggcggcgggctcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcatgggcggttcgccgtggacgtgatgctggtgctcagccaattcagcttctgcgtcggctacctcatcttcatctccaacaccatggcgcacctctatccgattaccgccgcggcctcgtcctcctccgcgctcctctcccccaaggcgctcgtcatctgggcgatgctgcctttccagctggggctcaactccatcaagacgctgacgctgctcgcgccgctcagcatcttcgccgacgtcgtcgacctcggcgccatgggcgtggtcctcggccaggacgtcgccgcctggctcgccaagcccgtgcccgtggtcgccttcggcggcgcaggcgcgcttctctacgggctcggcgtctccgtgtacgcgttcgagggcatcggcatggtgctgccgctggaggcagaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatcttccaatcgtcaagcgcttgatcgacgcgcgttccgctgcgcgtcgatcatcgcattctccagggcaactacgatacatgtgttgagtgttgttcgtgagtggcttgtattggacgggggaaatctgtacgcttttcgtaccacagatttcagttactcccggtagcagtgtatgtgtatgcgtcctagatgttcctcctgctgtgcacgatgggggatacgatgaaaggacaagattttcacttcgtggaaaaagcttattttgctgttaagtgccaacgtacttcatgcatccagtgctaatttcaattgtgaattggccccttggcccttcgagacaggccaagcagctaggacaaacggatcaattcgagtttgtacgctcgtaatttcggttcccttttcatttggaaggccaatttggatacgcaactgggacaagttgtatcaccacttgtcaaggtgtactcaattcagttccccagaataaaaatgtgacttcacacgac

SEQ ID NO: 719 - DNA, 2024 bp, Zea mays
  misc_feature (9)..(9): n is a, c, g, or t
cggtccggnattcccggctcgaccccgcgtccgagcagcacggcagtcctccgtttcctcctcgtcgctcgccccggttgtctcctcctcgacctcccccgtcgcgacaccgcccgatctctctagcgcacggcggacggagaagaggaggagggggggacgatctcattcatcggaccggcgtgcctgtgtcgtctgctgttttcgttattttttctttactctttttttttcttcctcctttgcttgttcaattcaatcagtataataagatttctgatttgggggcggctcgccatgggattcggaatggggaataataacaacggggcgagctcctcgtcgtcgaggctggacccggcggcgccgctgctgccgcgccacggcagcagcgggggccgcgagggtggtggcctgtcgtcgcagcccaagacgttcgccaacgtcttcatcgcggtggtcggcgccggcgtgctggggctgccgtacaccttctcgcgcaccgggtgggcggcgggctcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcatgggcggttcgccgtggacgtgatgctggtgctcagccaattcagcttctgcgtcggctacctcatcttcatctccaacaccatggcgcacctctatccgattaccgccgcggcctcgtcctcctccgcgctcctctcccccaaggcgctcgtcatctgggcgatgctgcctttccagctggggctcaactccatcaagacgctgacgctgctcgcgccgctcagcatcttcgccgacgtcgtcgacctcggcgccatgggcgtggtcctcggccaggacgtcgccgcctggctcgccaagcccgtgcccgtggtcgccttcggcggcgcaggcgcgcttctctacgggctcggcgtctccgtgtacgcgttcgagggcatcggcatggtgctgccgctggaggcagaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatcttccaatcgtcaagcgcttgatcgacgcgcgttccgctgcgcgtcgatcatcgcattctccagggcaactacgatacatgtgttgagtgttgttcgtgagtggcttgtattggacgggggaaatctgtacgcttttcgtaccacagatttcagttactcccggtagcagtgtatgtgtatgcgtcctagatgttcctcctgctgtgcacgatgggggatacgatgaaaggacaagattttcacttcgtggaaaaagcttattttgctgttaagtgccaacgtacttcatgcatccagtgctaatttcaattgtgaattggccccttggcccttcgagacaggccaagcagctaggacaaacggatcaattcgagtttgtacgctcgtaatttcggttcccttttcatttggaaggccaatttggatacgcaactgggacaagttgtatc

SEQ ID NO: 720 - DNA, 2977 bp, Oryza sativa
ggagagagagagagagaggggggagcggtcgcaggaggaggaggacggcggcgtctgctgcgaccgacggggagcggcgaggatgagcgcgtccaggttcataaagtgcgtcaccgtcggggacggcgccgtcggcaagacctgcatgctcatctcctacacctccaacaccttccccactgattatgttccgacggtgtttgacaacttcagtgccaacgtcgtggttgatggtaacaccgtcaacctcgggctatgggacactgcaggtcaggaggattacaacagactgagaccactgagttatcgtggagctgatgttttccttctggccttctcgctaatcagcaaggccagctatgagaatgtttcaaagaagtggatacctgagctgaagcattatgcacctggtgtgcctatcatccttgtgggaacaaagcttgatcttcgagatgacaagcagttttttgtggaccatcctggtgttgttcctatcaccactgctcagggagaggaactaagaaagcaaataggcgccccatactacatcgaatgcagctcaaagacccaactaaacgtcaagggcgttttcgatgcggcaataaaggtggtgctgcagccacccaaggcgaagaagaagaaaaaggcgcaaaggggggcgtgctccattttgtgatctaatcatcagtagacgacgaagaagaagaacgatgaagttgccaggctttattattgttgcgtcttgcttcagcgaaacagcattcatggtccggggatcctagtttactggcagctgcagcaaggcctctttgtcgaggcaatgagcgatccgtttgtttcattttctcctttctgccttgtgattatctcgtgtgactgacaagtcgtggcaattaggtaactttcctagatggtatttcctgtgtttgagaaaaaaattcttgttatccctgtttcataagtagacatgatgtaatcgcactcagtttattcttttccttcttatttcacttcaatggaaaattatgtttccccttcaaaaaaaaaaaaaaaaaaaaaatcagatcctccatcccgcggcggccgtgagcaccaacactcacgcattccttcctactccgcgagatctccggattcgtttcggtgttttgcgagtcgcgcccggagaagaggagaggaaatccggtcaatcgcggcgtcggcgtgccgtcgcttggggtggtgttggtggttctgaattttgattgcttcgtgcttttcgtttgggggagggcagtggtcgccatgggattggggaacgaggcgagctcgtcgtcgtcgcggctgctggatccggcgcctctgctgccgcaccacggtggagatggcgccgggaagctgtcgtcgcagcccaagaccttcgcgaacgtcttcatcgcggtggtcggcgccggcgtgctggggctgccgtacacgttctcgcggaccgggtgggcggcggggtccatcctcctgctctccgtcgcggcgctcaccttctactgcatgatgctgctcgtcgcctgccgccgccgcctcgccgacgagcacccgaagatcgcctcctttggggacttgggggacgccgtgttccgcggtccggggcgcctcgccgtggacaccatgctggtgctcagccaggccagcttctgcgtcgggtacctcatcttcatctcgaacaccatggcgcacctttaccccgtcttcgcgccctcctccaacgcgctcctctccccaaaggcgctcttcatctgggccatgctgccgttccagctcgggctcaactccatcaagacgctgacgctcctcgcgccgctcagcatcttcgccgatgtggttgacctcggcgccatgggcgtcgttctcggggaggacgtgtccgtctggctcgccaaaccaccacccgtcttcgccttcggcggcctgagcgcgatcctgtacggcatcggcgtgtccgtgtacgccttcgagggaatcggcatggtccttccgcttgaggcggaggccgccaacaagaagaagttcgggaccacgctcgggctatccatggggttcatcgccgtcatgtacggcctgttcggcgccatggggtacatcgctttcggcgacgccacgcgcgacatcatcaccaccaacctcgggaccgggtggctctcggccgccgtgcagctcgggctgtgcatcaacctcttcttcaccatgccggtgatgatgcaccccgtgtacgaggtcgccaagcggctgctccacggcaaacgctactgctggtggctgcggtggctgctcgtcctggccgtcggcctctcggccatgtacgtgcccaacttcaccgacttcctggcgctcgtcgggagcagcgtctgcgtcctgctcggcttcgtgctgccggcctcgttccacctcaaggtgttcggcgccgagatgtcctggtccggggtgctcagcgacgtcctgctcgtcctgctcggcctctcgctcgccgtcttcggcacctacacgtccctgctgcagatcttccattcctccagcgcttaatctctggagaatctttacggatagctgcgccgatgattgatttgctcatttgcttcgcgcgcgggtgtcagcctgtcaggtacgctggttgcattcttcgtgtacagagaaggtgatcggtcgatcagaggggcaatgcccaattcagcttgctgttgatttgggcatggacagcgtgcatcggccgcattctttcgattacaagtcagatggtttgtacaagttagcgtggatggcatggagaaatctgtatggttttgcaacgacagattcccatagctactcgtgtcagttaatatttatgtgtatgtcttggatgtttcagctgctgcattgcacggtggaatcgatgaaaggacatagtaagtttcagtctaagtttaagcctatttagttgataaataaagtgtctagttgaggttgc

SEQ ID NO: 721 - DNA, 3203 bp, Oryza sativa
ggagagagagagagagaggggggagcggtcgcaggaggaggaggacggcggcgtctgctgcgaccgacggggagcggcgaggatgagcgcgtccaggttcataaagtgcgtcaccgtcggggacggcgccgtcggcaagacctgcatgctcatctcctacacctccaacaccttccccactgattatgttccgacggtgtttgacaacttcagtgccaacgtcgtggttgatggtaacaccgtcaacctcgggctatgggacactgcaggtcaggaggattacaacagactgagaccactgagttatcgtggagctgatgttttccttctggccttctcgctaatcagcaaggccagctatgagaatgtttcaaagaagtggatacctgagctgaagcattatgcacctggtgtgcctatcatccttgtgggaacaaagcttgatcttcgagatgacaagcagttttttgtggaccatcctggtgttgttcctatcaccactgctcagggagaggaactaagaaagcaaataggcgccccatactacatcgaatgcagctcaaagacccaactaaacgtcaagggcgttttcgatgcggcaataaaggtggtgctgcagccacccaaggcgaagaagaagaaaaaggcgcaaaggggggcgtgctccattttgtgatctaatcatcagtagacgacgaagaagaagaacgatgaagttgccaggctttattattgttgcgtcttgcttcagcgaaacagcattcatggtccggggatcctagtttactggcagctgcagcaaggcctctttgtcgaggcaatgagcgatccgtttgtttcattttctcctttctgccttgtgattatctcgtgtgactgacaagtcgtggcaattaggtaactttcctagatggtatttcctgtgtttgagaaaaaaattcttgttatccctgtttcataagtagacatgatgtaatcgcactcagtttattcttttccttcttatttcacttcaatggaaaattatgtttccccttcaaaaaaaaaaaaaaaacaawaatcagatcctccatcccgcggcggccgtgagcaccaacactcacgcattccttcctactccgcgagatctccggattcgtttcggtgttttgcgagtcgcgcccggagaagaggagaggaaatccggtcaatcgcggcgtcggcgtgccgtcgcttggggtggtgttggtggttctgaattttgattgcttcgtgcttttcgtttgggggagggcagtggtcgccatgggattggggaacgaggcgagctcgtcgtcgtcgcggctgctggatccggcgcctctgctgccgcaccacggtggagatggcgccgggaagctgtcgtcgcagcccaagaccttcgcgaacgtcttcatcgcggtggtcggcgccggcgtgctggggctgccgtacacgttctcgcggaccgggtgggcggcggggtccatcctcctgctctccgtcgcggcgctcaccttctactgcatgatgctgctcgtcgcctgccgccgccgcctcgccgacgagcacccgaagatcgcctcctttggggacttgggggacgccgtgttccgcggtccggggcgcctcgccgtggacaccatgctggtgctcagccaggccagcttctgcgtcgggtacctcatcttcatctcgaacaccatggcgcacctttaccccgtcttcgcgccctcctccaacgcgctcctctccccaaaggcgctcttcatctgggccatgctgccgttccagctcgggctcaactccatcaagacgctgacgctcctcgcgccgctcagcatcttcgccgatgtggttgacctcggcgccatgggcgtcgttctcggggaggacgtgtccgtctggctcgccaaaccaccacccgtcttcgccttcggcggcctgagcgcgatcctgtacggcatcggcgtgtccgtgtacgccttcgagggaatcggcatggtccttccgcttgaggcggaggccgccaacaagaagaagttcgggaccacgctcgggctatccatggggttcatcgccgtcatgtacggcctgttcggcgccatggggtacatcgctttcggcgacgccacgcgcgacatcatcaccaccaacctcgggaccgggtggctctcggccgccgtgcagctcgggctgtgcatcaacctcttcttcaccatgccggtgatgatgcaccccgtgtacgaggtcgccgagcggctgctccacggcaaacgctactgctggtggctgcggtggctgctcgtcctggccgtcggcctctcggccatgtacgtgcccaacttcaccgacttcctggcgctcgtcgggagcagcgtctgcgtcctgctcggcttcgtgctgccggcctcgttccacctcaaggtgttcggcgccgagatgtcctggtccggggtgctcagcgacgtcctgctcgtcctgctcggcctctcgctcgccgtcttcggcacctacacgtccctgctgcagatcttccattcctccagcgcttaatctctggagaatctttacggatagctgcgccgatgattgatttgctcatttgcttcgcgcgcgggtgtcagcctgtcaggtacgctggttgcattcttcgtgtacagagaaggtgatcggtcgatcagaggggcaatgcccaattcagcttgctgttgatttgggcatggacagcgtgcatcggccgcattctttcgattacaagtcagatggtttgtacaagttagcgtggatggcatggagaaatctgtatggttttgcaacgacagattcccatagctactcgtgtcagttaatatttatgtgtatgtcttggatgtttcagctgctgcattgcacggtggaatcgatgaaaggacatagtaagtttcagtctaagtttaagcctatttagttgataaataaagtgtctagttgaggttgcagcttgtgtgcggtactgcgggttgtgtcaattaggaaggcaagcaatcgggacgacttggcaaagtatacattctattctgttcattctgttttgtcccaagcaagtaaacttgtaatgccccaactaccaatcgaaatatcgaatcttctttcagcttgcctgttattaccaatgttgcacatataattctatcacgaaagaactcaaattagattcagacaag

SEQ ID NO: 722 - DNA, 2096 bp, Oryza sativa
aatcagatcctccatcccgcggcggccgtgagcaccaacactcacgcattccttcctactccgcgagatctccggattcgtttcggtgttttgcgagtcgcgcccggagaagaggagaggaaatccggtcaatcgcggcgtcggcgtgccgtcgcttggggtggtgttggtggttctgaattttgattgcttcgtgcttttcgtttgggggagggcagtggtcgccatgggattggggaacgaggcgagctcgtcgtcgtcgcggctgctggatccggcgcctctgctgccgcaccacggtggagatggcgccgggaagctgtcgtcgcagcccaagaccttcgcgaacgtcttcatcgcggtggtcggcgccggcgtgctggggctgccgtacacgttctcgcggaccgggtgggcggcggggtccatcctcctgctctccgtcgcggcgctcaccttctactgcatgatgctgctcgtcgcctgccgccgccgcctcgccgacgagcacccgaagatcgcctcctttggggacttgggggacgccgtgttccgcggtccggggcgcctcgccgtggacaccatgctggtgctcagccaggccagcttctgcgtcgggtacctcatcttcatctcgaacaccatggcgcacctttaccccgtcttcgcgccctcctccaacgcgctcctctccccaaaggcgctcttcatctgggccatgctgccgttccagctcgggctcaactccatcaagacgctgacgctcctcgcgccgctcagcatcttcgccgatgtggttgacctcggcgccatgggcgtcgttctcggggaggacgtgtccgtctggctcgccaaaccaccacccgtcttcgccttcggcggcctgagcgcgatcctgtacggcatcggcgtgtccgtgtacgccttcgagggaatcggcatggtccttccgcttgaggcggaggccgccaacaagaagaagttcgggaccacgctcgggctatccatggggttcatcgccgtcatgtacggcctgttcggcgccatggggtacatcgctttcggcgacgccacgcgcgacatcatcaccaccaacctcgggaccgggtggctctcggccgccgtgcagctcgggctgtgcatcaacctcttcttcaccatgccggtgatgatgcaccccgtgtacgaggtcgccgagcggctgctccacggcaaacgctactgctggtggctgcggtggctgctcgtcctggccgtcggcctctcggccatgtacgtgcccaacttcaccgacttcctggcgctcgtcgggagcagcgtctgcgtcctgctcggcttcgtgctgccggcctcgttccacctcaaggtgttcggcgccgagatgtcctggtccggggtgctcagcgacgtcctgctcgtcctgctcggcctctcgctcgccgtcttcggcacctacacgtccctgctgcagatcttccattcctccagcgcttaatctctggagaatctttacggatagctgcgccgatgattgatttgctcatttgcttcgcgcgcgggtgtcagcctgtcaggtacgctggttgcattcttcgtgtacagagaaggtgatcggtcgatcagaggggcaatgcccaattcagcttgctgttgatttgggcatggacagcgtgcatcggccgcattctttcgattacaagtcagatggtttgtacaagttagcgtggatggcatggagaaatctgtatggttttgcaacgacagattcccatagctactcgtgtcagttaatatttatgtgtatgtcttggatgtttcagctgctgcattgcacggtggaatcgatgaaaggacatagtaagtttcagtctaagtttaagcctatttagttgataaataaagtgtctagttgaggttgcagcttgtgtgcggtactgcgggttgtgtcaattaggaaggcaagcaatcgggacgacttggcaaagtatacattctattctgttcattctgttttgtcccaagcaagtaaacttgtaatgccccaactaccaatcgaaatatcgaatcttctttcagcttgcctgttaaaaaaaaag

SEQ ID NO: 723 - DNA, 2170 bp, Sorghum bicolor
aaataggccggcgcccacgcgtcckactgsgcgatgttccccagacgcagcagcacggcagtcctacgtttgtttcctcctcgcagcaccggttccgttctctcctcctcgatttccctccgtcgcgagatcgcctgatctctctagcgcacggcggccggagaagaggacgggcacgatctcattcatcggatcggcgtgcctgtgttgtctgttgatttgattttttttttcttccttacttttttttggttcattcatcaatcaataataagatttctgatttggggcgtggttcggcatgggattcggaatggggaataataacggggcgagctcctcgtcgtcgcggctggacccggcgccgctgctgccgcaccacggcagcgggagccgcgaggtcggcctgtcgtcgcagcccaagacgttcgccaacgtcttcatcgcggtggtgggcgccggcgtgctgggactgccgtacaccttctcgcacaccgggtgggcggcggggacgctgctgctcttctccgtcgccgcggtcaccttctactgcatgatgctgctcgtcgcgtgccgccgccgcctcgccgacgagcaccctaagatcgcctcgttcggggacctcggggacgccgtgttcggcgcgcacggccggttcgccgtcgacgtcatgctggtgctcagccaagtcagcttctgcgtcggctacctcatcttcatctctaacaccatggcgcacctctacccgattaccgcgccgtcctcctcggccctcctctcccccaaggcgctcttcatctgggccatgctgccgttccagctcggactcaactccatcaagacgctcacgctcctcgcgccgctcagcatcttcgccgacgtcgttgacctcggagccatgggcgtcgtcctkggccaggacgcctcaatctggctcgccaacaagccccccgtgttcgccttcgctggccccgccgagctcctctacggcctcggcgtcgccgtctacgcsttcgagggsrtcggcatggtgctgccgctggaggcggaggccgcggacaagcgaaggttcggcgccacgctcgcgctgtccatggcgttcatcgccgtcatgtacgggctgttcggcgtgatggggtacgtcgcgttcggcgacgccacgcgggacatcatcaccacaaacctcggcgccgggtggctgtcggccgccgtgcagctggggctctgcatcaacctcttcttcacgatgccggtgatgatgaaccccgtgtacgaggtcgccgagcgcctgctccacgggaagcgctactgctggtggctgaggtggctgctcgtcatcgtcgtcggactcgccgccatgtacgtgcccaacttcacggacttcctggcgctcgtcgggagcagcgtctgcgtcctcctcggcttcgtgctgccggcctcgttccacctcaaggtgttcggcggcgagatggaatggcccggagtggtatccgatgtcctgctggtcgtgatcggcctcttgctcgccgtgttcgggacgtacacgtcgctgctgcaaatcttccactcgtcaagcgcttgatcgccgcaccttctgctacgcacggaggattaatttccttcctccgcgcactagattcaggtaccttggtcgcgctcctgtgttcagagaagtggattagaggattaggaggaacgaacgccaatctcagcagttcgtcctcgtccatttgggcctgtggatttcgcagagcaggttactgtgcaggtgttgttcgtgagtgacttgtacgggatggggaaggtaaaatctgtacacttttgttacgacagatttcaggtactcccggtatagcaatgtaataggagtgtgtcaatgtgtcctagatgttcctcctgctgtgcacgatggattcgatgaaaggacaagaattttcacttcgtgatcgtgagtggccacatatttggttgcagtgctaatttcacttgtgaattggtcctttgcccctccgaggcagtcctagctgctaggtctaacggacaagttccgagtttgtatcacgattcatgtgtacacttaaatttcggtttccttttcatttgtaaggctattctggattgtatcgctacttgtcaaggtatactcaatccagtccttacgagcaatgct

SEQ ID NO: 724 - DNA, 2395 bp, Saccharum officinarum
cacggcagtcctccgtttcctcctcgtcgcaccgcttctctcctcgatttcccccgtcgcgagatygccygatctctctagcgcacggcggccggagaagaggaggagggggacgatctcattcatcggatcggcgtgcctgtgttgtctgttgttttgatttttttctctttactctttttttgttcattcatcaatcaataataagatttctgatttgggggcggttcgccatgggattcggaatggggaataataacggggcgagctcctcgtcgtcgcggctggaccccgcgccgctgctgccgcgccacggcagcggcagccgcgaggccggcctgtcgtcgcagcccaagacgttcgccaacgtcttcatcgcggtggtcggcgccggcgtgctggggctgccgtacactttctcgcacaccgggtgggcggcggggacgctgctgctcttctccgtcgccgcgctcaccttctactgcatgatgctgctcgtcgcgtgccgccgccgcctcgccgacgagcaccctaagatcgcctcgttcggggacctcggggacgccgtgttcggcgcgcacggccggttcgccgtggacgtcatgctggtgctcagccaagtcagcttctgcgtcgggtacctcatcttcatctccaacaccatggcgcacctctacccgatcaccgsgccgtsctcctccgcgctcctctcccccaaggcgctcgtcatctgggcgatgctgccgttccagctcgggctcaattccatcaagacgctcacgctgctcgcgccgytcagcatcttcgccgacgtcgtcgacctcggcgccatgggcgtggtcgtcggccaggacgtcgccgcctggcttgccaagcccgtgcccgtggtcgcctacggcvgccctgccgcgcttctctacgggctcggcgtctccgtgtacgcgttcgagggcgtcggcatggtgctgccgctggaggcggaggcggcgaacaagaggaagttcggcgtcacgctcgggctgtccatggcgttcatcgccgtcatgtacgggctgttcggcgtgatggggtacgtcgcgttysgcgacgccacgcgggacatcatcaccaccaacctcggcaccgggtggctgtcggccgccgtgcagctggggctctgcatcaacctgttcttcacgatgccggtgatgatgaaccccgtatacgaggtcgccgagcgcctgctccacggcaagcgctactgctggtggctccggtggctgctcgtcatcgtcgtcggactcgccgccatgtacgtgcccaacttcacggacttcctggcgctcgtcgggagcagcgtctgcgtcctcctcgggttcgtgctgccggcctcgttccacctcaaggtgttcggcgccgagatggaatggcccggagtggtgtccgatgccctgctggtcgtgatcggcctctcgctcgccgtgttcggaacgtacacgtcgctgctgcacatcttccactcgtcaagcgcttgatcggcgcaccttctgctacgcatggaggatcaatttccttcctccgcgcattagtttcaggtaccttggtcgcgctcctgtgttcagagaagtggattagaggatttggcgctgttggtccatttgggcctggattttgcgtcgatcatcgcgttcttccggagcacattactatgcaggtgttgtttgtgagtggcttgtaccggatggggaagtggggaagggaaaatctgtacacttttgctacgacagatttcagttaccccccgctagcatgtaatacgagtgtaggtagcaaatgtaatacgagtgtatgcgtcctagatggtcctcctgctgtgcacgatggattcgatgaaaggacaatatttttcacttcgtgagttaacttgtgaattggccctttgcccctcsgaggttgtgaggcaggcctagcagctaggacaaacggscgartttgagtttgtatcactaytcatttggaaggctgttctagacaagcaattgggacgagttgtatcgcaacttgycaaggtrmaaaaaaaaaagttatatctttacgatgtatctaccttgccatcgtcgtcgccgtcgtcatcatggtggtcgtctttcttatttttccctggtggggcgcggccgtcttattatgggattctatgctctccttcttacgcgtttgcttgacgtacacctccttcattcttatttactatagacggtgcccactctatagatatcattttcttgcgtgcgagcgtctagatattatatctatatatcgatcgctgtctgtatatgcgaacaatcaagctattatgtctgtatctcccatctatattatttcatcccgtttagctatgatcacaaacgtacttctc

SEQ ID NO: 725 - DNA, 2590 bp, Triticum sp.
ctcgtgccggtttcctccgccgcgagatcgcccgttttctctcgatacttccgacgaccggagaggaagacgaatcccgtcgaattcgcctgctcgtggctccatcttccgtctctctgctgcgtgtggtggtcttgattcgtcgtgttaatttcgattcaatcgcccgggcgccatgggattggggagcgacgcgagctcgtcgtcgtcgcggctggactcggcgccgctgctgccgcaccacagcgccgaagggggccacctttcgtcgcagcccaagaccttcgcgaacgtcttcatcgcggtggtcggcgccggcgtgctgggcctgccctacacgttctcgcgcaccggctgggcggcgggctccatcctgctcctctccgtggcgctgctcaccttctactgcatgatgctgctcgtcgcctgccgccgccgcctcgccgacgaccacccgaagatgctctcctcgtttggggatctgggggacgccgtgttcggcgcgcccggccgcctcgccgtggacaccatgctggtgctcagccaggccagcttctgcgtcgggtacctcatcttcatctccaacaccatggcgcacctctaccccgtcttcgccccctcctcraaygtmttcctctcccctaaggcgctcttcatctacgccatgctgccgttccagctcgggctcaactccatcaagacgctcacgctcctcgcgccgctcagcatcttcgccgacgtcgtcgacctcggcgccatgggggtcgttgttggccaggacgtgtcgacttggctcgccgcgcacccacccgtcgccgcgttcggcgcccccgccgcgctcctctacggtgcgggcgtgtccgtgtacgccttcgagggcgtctgtatggtcctgccgctggaggcggaggccgcggacaagaagaagttcggcgccacgctcgggctgtccatggcgttcatmgctgtcatgtacgggctgttcggcgtcatggggtacgtcgcgttcggcgacgccacgcgcgacatcatcaccaccaacctcggcagcgggtggctgtcggccgccgtgcagctggggctgtgcatcaacctcttcttcaccatgccggtgatgatgaacccggtgtacgaggtcgccgagcgcctgttccacggaaagcgctactgctggtggatgcggtgggtgctcgtggtcaccgtggggctcgcggccatgcttgtgcccaatttcaccgacttcctctccctcgtggggagcagcgtctgcgtgctgctcggcttcgtgctgccggccaccttccacatcaaggtgttcggcgccgagatgggctgggtcggggttctcagcgacgtcctcctggtggtgctcggcctcgtgctcgccgtcttcggcacctactcgtcgctggtgcaaatcttccactcttccagcgcttaaattccggtattcgccgagggctaatctgctcggtgcattggctctctctcatccacgctggttaagatctcgcgtagtagttttccacgctaccactaccagaaggggatcagcggatcagagaggaattgcctggctcagctatttgttgatctgggaaatggattgcgtgcattcgtttgggaattcttgttcagattgttagtaygagatastactagttgattggaggcatggagaaatctgtatggttttgctacgacagattccgatcatgtctgcccatagcattcttctactctgttcatgtcctagatgttccagctgcagtgcatatggaatggatgaaaggatacgaatttcagtatttagttacttgtgcgccgtagtgtcagcgtgcaagattgtgtcttgtgtgtggttaattgggctgggcaagcaattgggacgacttacattgcttgtcaaagcaccattacgtgatactcctagcataaacattgtatacgtttcgaactgttgtactatgtcccaagcaagcaacataagcttgtaaagggtcccgaaggaataaaattggaactatgaattgcttttatttgactttggccactgtttcaggacagacattcctgagagagtcctgttacggcatcaatcaattggattgagattcacatatgaaaattggggaagaacccaaactctgaatacatggaacattaggagttctygtatatatttttttttgaaaaggattaggagttctcatgacatggtgttttcgtgctgatccattccattctgcatgcagaaggaacagggaaaacccggaagaagaaaaaagaggacgcagaccaaccgtgcaagctgcagtagccctgcgtgatcgatcagtcgtcctcacataccaggcgaagtatctcttcttatcttctcccctgcgccttccgtcacttttctctcgtcgcttctaccttttttatgcaggcaaaagcagaacgtcgttatcataacggaacgatccaagctgttgctgtcgtctggattagagcttatctttcagccattgaacggcttccgctgaacggcgacgtttttctccaaagcttcaccataaacaatgaggcaaactgatagcgactcgtg

SEQ ID NO: 726 - DNA, 1293 bp, Hordeum vulgare
cggcacgaggcctacatggaggccgtcgagtcctacctaggtagcaggcaggtgtggttttgtggcctctgccagtacgttaatctcgttggaactgcattcgggtacaccattacagcatcgatcagtgccgcggctttgtacaaggccractgcttccacarsaasggccactctgccgactgcggcgtgtacacyaccatgtacatggtcgtgtttgggatctcccagatcgtcttctcccagctccccaacctccacgagatggcctggctgtcgatgctcgccgccgtcatgtccttctcctactccaccatcggcgttggcctctccttggcacagaccatcaaaggtcctacgggcaagacaaccattggtggcactcaaattggggtggacgtcacttcggcccagaagatatggctgacattgcaagcgctcgggaacatcgcattcgcctactcatactccatggttctcatagaaatccaggacacggtgaaggcgccaccggcggagaacaagacgatgaggaaggcgaacctgatgggggtctccaccaccacggccttctacatgctctgcggctgcctcggctactcggccttcggcaacgacgcgccgggcaacatgctgaccggcttcggcttctacgagcccttctggctcatcgacttcgccaacgtgtgcatcgtggtgcacctcgtgggcgcctaccaggtgtactgccagcccatctacgccgccgtggagagctgggccgcggggcggtggcccaactcggagttcgtcgtccggcagtaccaccccttctccggcacgttcagcctcaacatgttcaggctggtgtggaggacggcgttcgtgatcgtgagcacggtgctcgccatctcgctgcccttcttcaacgacatcctcgggctgctcggcgcgctcggcttctggccgctcaccgtctacttccccgtggagatgtacatctcgcagagcaagatgaagaagtactccaggaagtgggtggcgctgcagaccctgagcttcgcctgcttcgcggtcacggtggccgtcaccgtcgcctccatccagggcatcacccagtcgctcaagaactatgtgccgttcaagaccaagttgtgaatgggatgattagcttagctgttgagtagagattcgttgacttgtgtttgtttaagatttttctcgagaaaaagctcgtcatctgtggactgtatctgtgtgattgatatttttagatgaatgtggaaaatctggtgggaaacctttggttggaac

SEQ ID NO: 727 - DNA, 2035 bp, Zea mays
gccctactcgagcgggctttcttcttcgagtcaataggaaccaaaatcccccaaccgccccagcgcacggcccggccgtctcaggcgtccgcggagatgacgcagcaggacgtggagatggcggcgcgccacgggaccggcgccgacggagcgggattctaccctcagccgcggaacggcgccggcggcgagacgctcgacgacgacggcaagaagaagcgcacgggaacggtatggacggcaagcgcgcacatcatcacagccgtcatcggctccggcgtgctctccctcgcctggtcgactgcacagctgggctgggtcgtggggccgctcaccctgatgatctttgccttgatcacgtactacacctctagccttcttgctgactgctaccgcagcggcgatcagctcaccggcaagaggaactacacctacatggacgctgttgccgcgtacctgggtactacgtactttctttgtgctcccgtcatgtcatctcagataagcaaacggttcgttttctgaatttcgacagtgaagatgatgcatgtcgatcgcgtatgatgcaggtcgatggcaagtcctgtcctgtggtgttttccagtatgttaactatggttggaactgccgttgggtatacaattacagcgtccatcagtgcagcgtgagtaattcttgcataaaaaaaggctcatttagtagtgaatgttttggcagattcagtctcatcgtcgattgagaaaccccttttggctgaatggcgatgagcagggccgtgcacaaggcaaactgcttccacaacaagggccacgcggccgactgcagcacctacgacaccatgtacatggtcgtatttgggatcgttcagatcttcttctctcagctccctaacttcagcgacctttcgtggctgtccatcgtcgccgccatcatgtcgttctcttactccagcatcgccgtcggcctctcgttggcgcggaccatttcaggccgtagtggtacgaccactctgaccggcactgagatcggagtcgacgttgattcagcccagaaggtctggctcgcgcttcaagctcttggcaacatcgcgttcgcttactcctactccatgattctcatcgaaatccaagacacggtgaagtctcctccagccgagaacaagacgatgaagaaggcgacgctgatgggcgtgacgaccaccacggcgttctacatgcttgctggctgcctcgggtactcggcattcgggaacgcggcgccagggaacatcctgaccgggttcggcttctacgagccctactggctgatcgacttcgccaacgtctgcatcgtggtgcacctggtgggcgcgtaccaggtcttctcccagcccatcttcgcggccttggagacggcggccgccaagcgctggccgaacgccaggttcgtcacgcgcgagcaccccctcgtggccggcaggttccacgtcaacctgctcaggctgacgtggaggacggcgttcgtggtggtgagcacggtgctcgccatcgtgttgcccttcttcaacgatatcctgggcttcctcggcgccatcggcttctggccgctcaccgtgtactacccagtggagatgtacatccggcagcggcgtatacagaagtacaccagcaggtgggtggcgctgcagctgctcagcttcctgtgcttcctggtgtcgctcgcctcggcggtcgcgtccatcgagggagtcaccgagtcgctcaaacactatgttccctttaagaccaagtcgtgatgactgactgagcttcaattctccggtccctgtacaatgcaatggcctaccaccttgcagtggtcgctaagggttatatagtccacatgaaaaactgatgtacatagaaaatcctgaccttcaaaaacagatttggtgtgtgattgttttgcaccgttatatctgattttgaagactaggattttatatgtgtacgtgtataccaaactttcatgtgtaccaaataccatgggctaatgaaaaactgatacaattgagtcc

SEQ ID NO: 728 - DNA, 1857 bp, Zea mays
gtcgacctcctctatggtcctttggtgttttccagymtactmgmgcgggctttcttcttcgagtcgataggaaccaaaatcccccaaccgccccagcgcacggcccggccgtctcaggcgtccgcggagatgacgcagcaggacgtggagatggcggcgcgccacgggaccggcgccgacggagcgggattctaccctcagccgcggaacggcgccggcggcgagacgctcgacgacgacggcaagaagaagcgcacgggaacggtatggacggcaagcgcgcacatcatcacagccgtcatcggctccggcgtgctctccctcgcctggtcgactgcacagctgggctgggtcgtggggccgctcaccctgatgatctttgccttgatcacgtactacacctctagccttcttgctgactgctaccgcagcggcgatcagctcaccggcaagaggaactacacctacatggacgctgtygccgcgtacctgggtcgatggcaagtcctgtcctgtggtgttttccagtatgttaacttggttggaactgccgttgggtatacaattacagcgtccatcagtgcagcggccgtgcacaaggcaaactgcttccacaacaagggccacgcggccgactgcagcacctacgacaccatgtacatggtcgtatttgggatcgttcagatcttcttctctcagctccctaacttcagcgacctttcgtggctgtccatcgtcgccgccatcatgtcgttctcttactccagcatcgccgtcggcctctcgttggcgcggaccatttcaggccgtagtggtacgaccactctgaccggcactgagatcggagtcgacgttgattcagcccagaaggtctggctcgcgcttcaagctcttggcaacatcgcgttcgcttactcctactccatgattctcatcgaaatccaagacacggtgaagtctcctccagccgagaacaagacgatgaagaaggcgacgctgatgggcgtgacgaccaccacggcgttctacatgcttgctggctgcctcgggtactcggcattcgggaacgcggcgccagggaacatcctgaccgggttcggcttctacgagccctactggctgatcgacttcgccaacgtctgcatcgtggtgcacctggtgggcgcgtaccaggtcttctcccagcccatcttcgcggccttggagacggcggccgctcaagcgctggccgaacgccaggttcgtcacgcgcgagcaccccctcgtggccggcaggttccacgtcaacctgctcaggctgacgtggaggacggcgttcgtggtggtgagcacggtgctcgccatcgtgttgcccttcttcaacgatatcctgggcttcctcggcgccatcggcttctggccgctcaccgtgtactacccagtggagatgtacatccggcagcggcgtatacagaagtacaccagcaggtgggtggcgctgcagctgctcagcttcctgtgcttcctggtgtcgctcgcctcggcggtcgcgtccatcgagggagtcaccgagtcgctcaaacactacgttccctttaagaccaagtcgtgatgactgactgagcttmaattctccggtcactgtacaatgcaatggcytaccaccttgcagtgstcgctaagggttatatagtccacatgaaaaactgatgyacatagaaaatcctgaccttcaaaaacagatytggtgtgtgattgttttgcaccgttatatctgattttgaagactaggattttatatgtgtacrtgtataccaaacyttcatgtgtaccaaataccatgggctartgaaaaactgatgcaattgagtcccgtgc

SEQ ID NO: 729 - DNA, 2361 bp, Oryza sativa
gccagagattccacttcattaatacttcggttccacattccacaggaatcctgcaatgaaaaacaaaaaaaactgaatctctccaaccaccattgatttccgatttcagagcccatatttgacctccatgcatttgcaatcaacaggttaaaacggaagccgcgtccattcaaatcgcttcgataaattgcccaaaaacaaaaaaccgaaaccaaaacagaaaaaataaaaggtgaacgagggaccctgccgccatacgcgtcgagtaccattcacttgtagtgtatatatactgccaccattcactcgttccccccgcatcgcatcctctccccacacaatccccacccggcctagcgagcgagagagagggaagggttgcgacttgcgactcgcgagcggcgagatggcgaaggacgtggagatggcggtgcggaacggagacggcggcggcggcggcggctactacgccacccacccgcacggcggcgccggcggcgaggacgtcgacgacgacggcaagcagcggcgaaccggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtggctggcaagtctggtcctgtggtgttttccaatatgtcaacctggttgggacagcaattgggtacacaatcacagcatccatcagcgcagcggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgctactggtaagactactctgactggcgttgaggttggagttgacgtcacttcagcccagaagatctggctcgcgttccaagcgctcggtgacatcgcgttcgcctactcctactccatgatccttatagaaattcaggacacggtgaagtctccaccggcggagaacaagacgatgaagaaggcaacgctgctgggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgtaatgaatcggaatgtttaacaaacaaggcttgttctgaactcttctcagggacaggcatggataacagattaaagataaatgaatgtgttagacaagggcagattagaagcggctcttaagcttcacacaatggttttttctctttcttttattaatgaaaccaaagcagttgaacaattgagcaatatgattaatgagaaacgactggaggtctcactcctctttataaaattcgatacagaagttcttgctctc

SEQ ID NO: 730 - DNA, 2019 bp, Oryza sativa; identical to SEQ ID NO: 96

SEQ ID NO: 731 - DNA, 1849 bp, Triticum sp.
attatycackcgtycksgttctggacagccacaccacctacccatcctcccagccagaggcacggcacagctagagggaggtgagggaggaagggggagagggacgatcgcagcactgcactgacggagggatgaccaaggacgtggagatggcggcgcggaacggcggcaacggcgccgtcgccggcgaggcctactacccctctcccccggcgcagggcggcgacgccgacgtggacgacgacggcaagcagcggcgcacagggacggtatggacagcgagcgcgcacatcatcaccgccgtcatcggctccggcgtgctctccctcgcctgggcaacggcgcagctgggctgggtcgtcgggccgatcaccctgatgctcttcgcggcgatcacctactacacctccggcctcctcgcggactgctaccgcaccggcgatccgctcaccgggaagaggaactacacctacatggacgccgtcgcatcctacttgagtcggctggcaagtgtgggcctgtggygtttttcagtacgtcaacttggtcgggactgcaatcgggtacacgatcacagcgtccatcagcgcggctgctataaacaaggccaactgcttccacaagaacggccgggcggcsgactgcggcgtgtacgactccatgtacatggtggtgttcggggtcgtccagatcttcttctcccaggtccccaacttccacgacctgtggtggctctccatcctcgcggcggtcatgtcgttcacctacgcctccatcgccgtcggcctctccctggcgcagaccatatcaggycctaccggcaaggccaccctgaccggcaccgaggttggagtggacgtcgattcggcccagaagatctggctcgcgttccaggcgctcggcgacatcgccttcgcctactcmtactccatgatcctcatagaaatccaggacacggtgaaggtcgccgccggcggaraacaagacgatgargaaggcgaacctgatgggggtctccaccaccacggccttctacatgctgtgcggstgcctcggctacgcggcgttcggcaacggcgccaaggggaacatcctcaccggcttcggcttctacgagccctactggctcatcgacttcgccaacgtgtgcatcgtggtgcacctggtgggcgcctaccaggtgttctgccagcccatcttcgccgctgtcgagaccttcgccgcggccacctggcccaacgccgggttcatcacccgcgagcaccgcgtcgccgccggcaacggcaagcggctcggcttcaacctcaacctcttcaggctgacgtggaggacggcgttcgtgatggtgagcacgctgctggccatcctcatgcccttcttcaacgacgtcgtcggcttcctcggcgccatcgggttctggccgctcaccgtctacttccccgtggagatgtacatccggcagcgcgggataccgaggtacacgacgaggtgggtggcgctgcagacgctcagcttcctctgcttcctggtgtcgctcgccgcggcggtcgcgtccatcgagggcgtcacggagtcgctcaagaactacgtcccgttcaagaccaagtcgtgaggatgggagtttttgcatgctgtcaaataattggccgtcgacaatgcttgtttgtgtgtgatgggaaaccatcgtcggctgggtgcgtcggtggggggtttatcccgtgttacgtacgcccggctgtgttgctcagaaactcgaggaagggagagatgtatagatcaccctatatcctacaggctgcagatgttggtcctcactttatgtacagaaacttgagctcacacaaaaact

SEQ ID NO: 732 - DNA, 1254 bp, Zea mays
cctcttcccttcccaacccaacccacttgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgagggacaaggacggggactggatgctcgtcggcgatgtgccgtgggagtgagcactgcatgcatgcgcttcttcctgcactatactccttattatattattgcctaatcggaaaataataataatttccatttcattttcaggatgttcgtcgaatcatgcaagcgccttcggatcatgaaaggatcagaagccattggcctggcgccaagggccatgggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtc

SEQ ID NO: 733 - DNA, 1550 bp, Zea mays
cctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttcattgtctctggtattagctgttccatggaacaggattatatatataagctcagtgatgaaataaaaaa

SEQ ID NO: 734 - DNA, 1517 bp, Sorghum bicolor; identical to SEQ ID NO: 99

SEQ ID NO: 735 - DNA, 1538 bp, Sorghum bicolor
aaacaggaagagagggagagcgatgatcatattacaacacaacttttttttaacagcttgaaacagttatttgttccactgacacaccgtggtaattataattaaacaacttttgatggacaagatgcaaaagggccccttgattaggagcagggtgcctttgcattttgagccaccaaaaaaaaagaagaggaggagagaacaggtagtgcaaaaagacattgttataggacaggtacatgttcatggcttctcttctgtagtataggacaagatgagacttgaacactgagtgatcgactcgtttactgacaaactggcacagatatgatagaacagttgacacaccaaaatgacttcattgatcaggagatatagaggcttggagttggagagcagggacgatatgatacagaggcgagcagagctgcaaaagctatggagattggttcttcttgcacccatccatggtgttcagatgcaatgcaagctttcaatcttctcctcagcttctgttcttgcatttctccatggcccttggtgcgaggccaatggcttctgatcctttcatgatccgaaggcgcttgcatgactcgacgaacatctcccacggcacgtcgccgacgagcatccagtcgccgtccttgtcctcgtaggtcggcacgtactcggagccgttgagcagatccaccagcttgctctcgttcatgccgttcatcccttgagacccacagcttccaatggtgaaggagctgaacatcttctcgagcgccttggacagctcctggtagctcttgtacatcttgaggtccaccttgcgcaggtacggcgcgccgtccaagctcaccttcacgaacgccgcaccaccgccagctgccgccgccggcgaggacttgtcggcgtctttgctgccgccggcgcccttgtcggactgcacggacatgatgttcttccggaacgaccggaccggtggccatcccaccacctgagccttgggggcgcgcggcttctcggcggggtcagcctgcacggcggcggcggtgacgacgctgctctggctcggggacctcttcatcttcccgccgacggcggcctcctccgcggcggccacgcagccggcgtcttccttggcggcggcaacaccgtcctgatgctcgtccgcctccgccgccttcaatacggccgcgggagtcgccggctccagcttcagcttgaggtcgatggtctctgcgaagcccctcttcccggaggagacgacagagctcctcccttcgccgaccacctctcccccgccgccgggcaggcccagacggagctccgtctcctcgaaccccaggtccgtcgtcgccattgctgctgcaggcgccactggcctagctcctcacctctcggctctcgccttcttcttcttccctgcttctgcttcgtttgctttgctttgcttgcgagccaggacgaggaggccggctggctttgcaaatgtaaaggaggaggctttgcaaatgcaaggggattggaagaggggccacgaccacgag

SEQ ID NO: 736 - DNA, 1535 bp, Sorghum bicolor
ggtgaaaaaacagagagggagagcgatgatcatattacaacacaacttttttttaacagcttgaaacagttatttgttccactgacacaccgtggtaattataattaaacaacttttgatggacaagatgcaaaagggccccttgattaggagcagggtgcctttgcattttgagccaccaaaaaaaaagaagaggaggagagaacaggtagtgcaaaaagacattgttataggacaggtacatgttcatggcttctcttctgtagtataggacaagatgagacttgaacactgagtgatcgactcgtttactgacaaactggcacagatatgatagaacagttgacacaccaaaatgacttcattgatcaggagatatagaggcttggagttggagagcagggacgatatgatacagaggcgagcagagctgcaaaagctatggagattggttcttcttgcacccatccatggtgttcagatgcaatgcaagctttcaatcttctcctcagcttctgttcttgcatttctccatggcccttggtgcgaggccaatggcttctgatcctttcatgatccgaaggcgcttgcatgactcgacgaacatctcccacggcacgtcgccgacgagcatccagtcgccgtccttgtcctcgtaggtcggcacgtactcggagccgttgagcagatccaccagcttgctctcgttcatgccgttcatcccttgagacccacagcttccaatggtgaaggagctgaacatcttctcgagcgccttggacagctcctggtagctcttgtacatcttgaggtccaccttgcgcaggtacggcgcgccgtccaagctcaccttcacgaacgccgcaccaccgccagctgccgccgccggcgaggacttgtcggcgtctttgctgccgccggcgcccttgtcggactgcacggacatgatgttcttccggaacgaccggaccggtggccatcccaccacctgagccttgggggcgcgcggcttctcggcggggtcagcctgcacggcggcggcggtgacgacgctgctctggctcggggacctcttcatcttcccgccgacggcggcctcctccgcggcggcgccacgcagccggcgtcttccttggcggcggcggcggcaacaccgtcctgatgctcgtccgcctccgccgccttcaatacggccgcgggagtcgccggctccagcttcagcttgaggtcgatggtctctgcgaagcccctcttcccggaggagacgacagagctcctcccttcgccgaccacctctcccccgccgcctccgccgccgccgggcaggcccagccggagctccgtctcctcgaaccccaggtccgtccccattgctgcttctgcttcgtttgctctcgccttcccctgcttctgcttcgtttgctttgctttgctttgcttgcgagccaggacgaggaggccggctggctttgcaaatgtaaaggaggaggctttgcaaatgcaaggggatgggaagaggggccacgaccacgaga

SEQ ID NO: 737 - DNA, 1513 bp, Saccharum officinarum
gcccctctttccaatccattgcatttgcaagcctttacattgaaaagcctcctccttcctcctgcaaagcaaagcaaacgaagaagaagccaaccagcagagaagaagcagggaaggagagacaccagcagcaagcgagaggtgaagaggtggcgcctgcagccgcaatggcgacggacctggggttcgaggagacggagctccggctgggcctgcccggcggcggcggaggcgggggagagctgggcggcgaggggaggagctcctcctccggcaagaggggcttcgccgagaccatcgacctcaagctgaagctggagccggcgacccccgcggccgtcgtgaaggcggaggaggacgacgagcaggacgacggtggtgttgcccttgccgccgccaaggaagctgccgccgccacggaggaggccggcgggaagatgaagcggtccccgagccagagcagcgtcgtcaccgccgccgccgttcaggctgaccccgccgagaagccgcgcgcccccaaagctcaggtggtgggatggccaccggtccggtcgttccggaagaacatcatgtcggtgcagtccgacaagggcgccggcggcagcaaagacgccgacaagtcctcgccggcggcggcggcagcagcagcagttggcggtgccgcgttcgtgaaggtgagcttggacggcgcgccatacctgcgcaaggtggacctcaagatgtacaagagctaccaggagctgtccaaggcgctcgagaagatgttcagctccttcaccattggaagctgtgggtctcaagggatgaacggcatgaacgagagcaagctggtggatctgctcaacggctccgagtacgtgccgacctacgaggacaaggacggcgactggatgctcgtcggcgacgtgccgtgggagatgttcgtcgaatcatgcaagcgccttcggatcatgaaaggatcagaagccattggcctcgcgccgagggccatggagaaatgcaagaacaggagctgaggagaagatggaagcttgcatctgaacaccaaggatggatgcaagaagatccgatctccacagcttttgcagctctgctcgtctctgtatcatactcgtctctgtcctccaagcctctatatctcctgatcaatgaagtcattttggtgtgtcaactgttctatctgtgctagtttgtcagtaaacgagtcagtcagtgttcaagtctcatcttgtcctatacagaagagagaagacatgaacatgtgtacctgtcctataacaatgtctttttgcactacctgttctctcctcttcttcttttttcttttttttttggtggcacaaaatgcaaaggcaccctgctcctaatcaaggggcccttttgcatcttgtccatcaaaagttgtttacttataattaccacggtgtgtcagtggaacaaataattgttgcaagctgttaaaaaaaagctgtattgtatgatctttgctctccctctcttatttgttattttc

SEQ ID NO: 738 - DNA, 1435 bp, Saccharum officinarum
tctggcaccgctccggtccgtgtattcccgcgtcgccccacgcgtccgcaccagcagcaagcgagaggtgaagaggtggcgcctgcagccgcaatggcgacggacctggggtttgaggagacggagctccggctgggcctgcccggcggcggcggaggcgggggagagctgggcggcgaggggaggagctcctcctccggcaagaggggcttcgccgagaccatcgacctcaagctgaagctggagccggcgacccccgcggccgtcgtgaaggcggaggaggacgacgagcaggacgacggtggtgttgcccttgccgccgccaaggaagctgccgccgccacggaggaggccggcgggaagatgaagcggtccccgagccagagcagcgtcgtcaccgccgccgccgttcaggctgaccccgccgagaagccgcgcgcccccaaagctcaggtggtgggatggccaccggtccggtcgttccggaagaacatcatgtcggtgcagtccgacaagggcgccggcggcagcaaagacgccgacaagtcctcgccggcggcggcggcagcagcagcagttggcggtgccgcgttcgtgaaggtgagcttggacggcgcgccatacctgcgcaaggtggacctcaagatgtacaagagctaccaggagctgtccaaggcgctcgagaagatgttcagctccttcaccattggaagctgtgggtctcaagggatgaacggcatgaacgagagcaagctggtggatctgctcaacggctccgagtacgtgccgacctacgaggacaaggacggcgactggatgctcgtcggcgacgtgccgtgggagatgttcgtcgaatcatgcaagcgccttcggatcatgaaaggatcagaagccattggcctcgcgccgagggccatggagaaatgcaagaacaggagctgaggagaagatggaagcttgcatctgaacaccaaggatggatgcaagaagatccgatctccacagcttttgcagctctgctcgtctctgtatcatactcgtctctgtcctccaagcctctatatctcctgatcaatgaagtcattttggtgtgtcaactgttctatctgtgctagtttgtcagtaaacgagtcagtcagtgttcaagtctcatcttgtcctatacagaagagagaagacatgaacatgtgtacctgtcctataacaatgtctttttgcactacctgttctctcctcttcttctttttttctttttttggtggcacaaaatgcaaaggcaccctgctcctaatcaaggggcccttttgcatcttgtccatcaaaagttgtttacttataattaccacggtgtgtcagtggaacaaataattgttgcaagctgttaaaaaaagtgtattgtacgatctttgctctccctctcttatttgttattttc

SEQ ID NO: 739 - DNA, 2056 bp, Zea mays
cctcgaggccggccgggattskgwamccgamcggccsksagccatcttcatctgcctgctggtgccggactgacggttagagatggcccacccctccgccgccgccgccgccgtatcctccacggcgcccgctgcaaaccctagttctggcgcccgcgaggaaggaggcgcccgctctccgccgtcgccgtctccgtctcagagggggcgggccaaggtggtgatcgttatgggcgccacgggcgccggcaagtcgcggctggccgtcgacctcgcggcccacttcgccggcgtcgaagtggtcagcgccgactccatgcagctctaccgcggcctcgacgtcctcaccaacaaggctcccctccacgagcagaacggtgttcctcatcatctacttagcgtgattgatccctctgtcgagttcacttgccgtgatttccgcgaccgtgccgtgccgattatacaggaaatagtggaccgcggtggcctccctgtggttgtcggcggcacaaacttctacatccaggctctcgttagcccattcctcttggatgatatggcagaagaaatgcagggctgtactctgagagatcacatagatgatggtcttactgatgaagatgaaggcaatgggtttgaacgcttgaaggagatcgatcctgtggctgcgcagaggatccatccaaacgaccatagaaaaatcaaacgctacctcgagttgtatgcaaccacgggtgccctacccagcgatctgttccaaggagaggccgctaagaaatggggtcggcctagtaactccagactcgactgctgtttcctgtgggtagatgctgatcttcaagtcctggacagttatgtcaacaaaagggtcgattgcatgatggatggtggcctgctggacgaagtatgcagcatatatgatgcggatgctgtctatacccaggggctgcggcaggctattggggttcgtgagtttgacgagtttttcagagcatatttacccagaaaagaatctggtgagggttcctgtgcaagcctgttaggtatgcatgacgatcagcttaagagcttgttggacgaagctgtttcccagctgaaggcaaacactcgtagactagttcgacgtcaaagacggagattgcatcggctgagtaaagattttgggtggaacttgcatcgtgttgacgcaaccgaagcattcttctgtaagtccattggtaccctgtcagatgcgtatgccttctctgtagcaactcataatctccctctcatattttgataggtgccactgacgactcatggcaaaagaaagttgtcaaaccatgtgtggatgtcgtaagaaggtttttgtcggacaattccactgttttgccaagcacaagcgcaagtgacccctcttcaagagagctgtggacgcaatatgtgtgcgaggcctgcggcaaccgggtgctgcgaggtgcgcacgagtgggagcagcacaggcaagggcgaggccaccggaagcgagtgcagcgcctgaagcagaagagcctgaggccatggccatcgctgctgccccaagaccgcagctgatggtaactttttcacagcagaaccggcgagaagtgggacggggacgttgacgtggacatggtcgtctcgtcccacccaaaaaagcgtgccagcctgacagcgacatgctttcccaatcccgaattcctggcacgtcgacggggggamtacctccatgccttttagcagckgaagaagcaggcaccaaagaactgcttrtcaaaagtattgtaccacacgtacgacgggtctagaagccacagaaacgtagtgtggaagtggatagatacwtgaacaatggtccatctttctatactgctaaagtttagcatatgctaaggaggygtttaagattgctaaaatctctattttcaaaaccgaagtattgcaaatactgtagttattttaagctattctaaacttaggtctggayctyagtttgcaaaactgtattgwmmwsastwwgtaaaactgtattatttyaaactgtggtattgyaatkact

SEQ ID NO: 740 - DNA, 1137 bp, Hordeum vulgare
ggaagcacgacaagtagcacgcgccccccacggcatctcctctcctagtccgctcgattcctcgcccttcctgctcggcggcgatggctttgccccccgcgagcgtcgagccggtgatcgcagaggtggagatgaacgccggcgccgatcagggtgccaccaccgtgcgggcaactgttgtgcaggcctccagcgtgttctacgacacccctgcaacgctcgataaagcagagaaattgatagcggaggcagctgggtatggttcacagttggttctttttccagaggtctttgttggtggctaccctcatgggtctacctttggactgactattggcagtcgatctgccaagggaaaagaagactttcggaagtatcatgctgctgccatagatgtgcctggcccagaggttagccgcttagctgcattggctggaaaatacaaggtcttcttggtgataggggttgttgaaagggcaggctacacactgtacaatacagtgctctcctttgattctctgggaaagtatctaggaaagcaccgcaagctcatgcctaccgcactggaacgggtattctgggggtttggagatggatctaccatacctgtttatgatactccacttggaaagattggtgccgtcatctgctgggagaacagaatgccacttatcagggcagcgatgtatgccaaaggtgttgaaatatactgtgctcccactgctgatgcgctgccaagttggcaatcttccatgacacatattgcgcttgaagggggatgctttgttctgacagcaaaccagttctgcctcagaaaagactttcctcccccacctgagtacacctttggtggccatgaggaggagccatccccagaaaccgctgtttgtcctggagggagctccatcatttcgccatctgggacagtgctggcaggtcccaactatgaaggcgaggccctcctcacagctgacctggaccttggagaaattgttcgagccaagtttgatttcgacgtcgtgggacactacgcccgacctgaggtgctgagcttgaccgtgaagactgaaccgaaacatgccgtgtctttcacttctactgtcggataagattcgaggcgcaaagatgattttattt

SEQ ID NO: 741 - DNA, 1504 bp, Hordeum vulgare
ctccccatccactcccgggcagctgctatcaaccgtcgccctctttgccttcggcgcggggctcctcacctacggcgctcacctctcctacgtccacatcgagccccagcgcgcgcgcaccctcgcccgcgatcagttcgtccgcgactacctacgcaggaagcacgacaagtagcacgcgccccccacggcatctcctctcctagtccgctcgattcctcgcccttcctgctcggcggcgatggctttgccccccgcgagcgtcgagccggtgatcgcagaggtggagatgaacgccggcgccgatcagggtgccaccaccgtgcgggcaactgttgtgcaggcctccagcgtgttctacgacacccctgcaacgctcgataaagcagagaaattgatagcggaggcagctgggtatggttcacagttggttctttttccagaggtctttgttggtggctaccctcatgggtctacctttggactgactattggcagtcgatctgccaagggaaaagaagactttcggaagtatcatgctgctgccatagatgtgcctggcccagaggttagccgcttagctgcattggctggaaaatacaaggtcttcttggtgataggggttgttgaaagggcaggctacacactgtacaatacagtgctctcctttgattctctgggaaagtatctaggaaagcaccgcaagctcatgcctaccgcactggaacgggtattctgggggtttggagatggatctaccatacctgtttatgatactccacttggaaagattggtgccgtcatctgctgggagaacagaatgccacttatcagggcagcgatgtatgccaaaggtgttgaaatatactgtgctcccactgctgatgcgctgccaagttggcaatcttccatgacacatattgcgcttgaagggggatgctttgttctgacagcaaaccagttctgcctcagaaaagactttcctcccccacctgagtacacctttggtggccatgaggaggagccatccccagaaaccgctgtttgtcctggagggagctccatcatttcgccatctgggacagtgctggcaggtcccaactatgaaggcgaggccctcctcacagctgacctggaccttggagaaattgttcgagccaagtttgatttcgacgtcgtgggacactacgcccgacctgaggtgctgagcttgaccgtgaagactgaaccgaaacatgccgtgtctttcacttctactgtcggataagattcgaggcgcaaagatgattttattttcaagacctgatgtccagtaatcctcaatagtcatgtataacaaagttgtcatccagtgtacattacagcaataattgtgtctttatatttttgtaaagattcggagaagatgcttgttagcataaacaattaagtcatgcacatgtcctattttacaggtcttgtcatcatttgttctttactggtcacgcgcttctgagcggccgcc

SEQ ID NO: 742 - DNA, 1554 bp, Zea mays; identical to SEQ ID NO: 393
  misc_feature (1533)..(1533): n is a, c, g, or t
  misc_feature (1535)..(1535): n is a, c, g, or t
  misc_feature (1538)..(1538): n is a, c, g, or t

SEQ ID NO: 743 - DNA, 1593 bp, Zea mays; identical to SEQ ID NO: 394
  misc_feature (1572)..(1572): n is a, c, g, or t
  misc_feature (1574)..(1574): n is a, c, g, or t
  misc_feature (1577)..(1577): n is a, c, g, or t

SEQ ID NO: 744 - DNA, 4145 bp, Zea mays
cgagccggcgggtgagcttatcttagccgattgtaagcactgaacttacttttctgccccgttaacctataaaaatggaggggataacctctatttttgtggtccacaaggcacacctgatactggttgcatattactgagcagaagcacttaaacaggcatttactttctattttaggtcttaggatacttgtataggaagagagcatagctgaagtgggaggtgtggttgtgcatctcaatcacccagattcatgtcctcttcaacataattctgttgcctattttcttgttaatggaaaaccacctagttctccaaggttgggaaatggggtgaattatcctttggaagtagagttatgtggttgacaagatcttgaaaaactgcatatatttttttttcatatgagcatgtgcatccattttctcatctcctgggaaattttctgacaataaatgcacgaaccacattaatgtttggtggtgcaatttaactaagtatcattcccaaatagcttcctatgtgtggtaaggcagtagggcactgctatttatagaatttgcactgagcacgtgtctacctttgctgttttacattagatgattctcattgtagtttatatcttgtaccaccattacctactgtcatccacgcttccttctagatatttttacatgttgcaaagggtgtgtagtacacatctgttatttctgyggagcacttcacaagcatattatcaacgcacctcctggcgattgggtacctcgaggccggccggtcagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctggtaaattaaacaggcttggataaattagtgtttcaatttagagttttggacagattgcttgtagggatttgaaaagattacttgcatggataaatggattttgtttgtacagatcgtatgtacagattgtgttaaaaatattatttgatgttgttggaatgttaatttgtgataaatttctgttagaatgatgtaattttagtgttgttgatttcacaatgtcaagtgtctatggcgtctccatgcaagtacacactacactggcaccgcgattgacagtcagaactttgattgcccgtccaataggtaccggtgggtgctattattattattttaatatttacatttaaattgaattatttttaattgttttatctactatataattctattcatttaattaagtaatcagatttatttgtattttaaatgttgtatttttaggttagctaaaagactaattttatattcgttaaataatgtgactagagtgacttcggtacagacgacaaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaggaagactttcagaagtatcacgcatctgccatagatgtgcctggtccagaagtgtcccgcttatctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggacgatgactatgtgcagacctaatgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattatacatggattggacgagattggcgcctcgaggccggccgggctagcttcagaacgaactaaaacccgcgatctgaagcgactagtcgaaggcggcggcggcggcgatggggagcgacctggagacggagaagaagaagaccccggtggcgctgatgcccatcgcgaagccyctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcaggaaccactaagaggccaacttgttgcgtcctggttctgaccaaaccaaacaagggggagctcagtgacgaggtgaaggataaactgaagtcagactatgaccaagttgtaacggaagttgctgaggctacatctgcaatgttctaaggaccattcagggaccacatcacctgagaatcatgcagctcgctgtgcgcattcttggcgtactatgtaacctgatccctgtcagtctgccctgcttgcgtgaaccgcaccagtatgctttgcatggtggctggagggatatgactatatgagtttacctatatattatggactatccttgttggcgtattgttgtattaacgattacatttagccagttataatccgttcggtgagcagattgtgtttgcttgggttaccagatcttggtagccagtgggtgcggttccaggtcttctgttgatgacttatcacaagatgtgcttgtgattcccgtgtatgaggaattgcgacatcttagaggcttaggctatggtcagtagatcttgccttgcctcgtgtataataatactgttttgtatcgtagacaatattgtttacagagatgatgatgagtaagctgctggacatagccagtgccttatatcagggttagtttttggccaaaaaaaaaattatatatttttttttattatataataattatattattaattaattaattt

SEQ ID NO: 745 - DNA, 1556 bp, Zea mays
tttttttatattcgttaaataatgtgactagagtgacttcggtacagacgacaaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaaggaagactttcagaagtatcacgcatctgccatagatgtgcctggtccagaagtgtcccgcttatctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggacgatgactatgtgcagacctaatgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattaaaaacgt

SEQ ID NO: 746 - DNA, 1619 bp, Oryza sativa
gcggatggggttgtgctccccgtccactcctcgtcagcccctctccaccgtcgctctcttcgccttcggcgcaggcctcctcgcctacggcgtccacctctcctacgcccacgtcgagccccagcgggcgcgcacgctcgcccgcgaccagttcgtccgcgattacctcaaaaggaagtacgacaagtagcacacggcctccccccctccccccaacgagatccccttcccgctcaatttcttgggaggggtgggggagcgatggctttggcccccgcgagctcgggcagtgggccggtggttacggaggtggagatgaacgccggcgccgaccagggtgccaccggcaccgtgcgtgccaccgtcgtgcaggcctgcaccgtgttctacgacacccctgcgactctcgataaagcagagaaactggtagctgaagcagctggatatggttcacagatagttctatttccagaagtctttgttggtggttaccctcatggatctacctttggactgactattggcaatcgatctgccaagggaaaggaagacttccataaatatcatgcagctgctatagatgtgcctggtccagaggtgacccgcttagctgcattggctggaaaatacaagattttcttggtgatgggggtggttgaaagggtagggtacacactatataatacagtgctcttctttgatcctctggggaaatacctcgggaaacaccgcaaggtcatgcctactggactggaacgagtgttttgggggtttggggatggatctactatacctgtttatgatactccaatagggaagattggtgccgtcatttgctgggaaaacagaatgccacttctcaggacagcaatgtacgctaaaggtgttcagatatactgtgctccaactgctgatttctcgcctagttggcaggcctccatgacgcatattgccgttgaagggggatgctttgtactttctgcaaaccagttttgtcgcagaaagaactatccaccagcgcctgaatatacttttggtggccttgatgaagagccatccccagaatctgttatttggcctggaggaagttccatcgtctcaccatctggaacagttctggcaggtccaaactatgaaggcgagggcctcctcacagctgacttggaccttggagaaattgctcgagctaagtttgatttcgacgtcgtgggacactatgcacgacccgaggtgctgagcctgaccgtgaaaaccgaatcaaagctgcccgtttcttttacttctgctgcagagaaaaattctgctgcaaagagtgacggtatctctaggacctgatggccattaatcttccatcgcggtgtgcaataaaattgtcagctggccagtgttggtatcacatgaataatctgtctttagtttcttgtaaagatttggagacgatgcttccctgataaacaattggtgcctatagtgctgtaatactcgtctgaaaatcgtgtcatgtttcttcctcttattcgttagtgaagacgtcccaactcccaaatgtagattgcgataacacagtactcagtattcatttccaacaatcatacagtattctacattccatttctacc

SEQ ID NO: 747 - DNA, 1678 bp, Oryza sativa
gtcgccgtcgcattcaccttttacaatccggtccccccaccaaaaacactcctcgcggatggggttgtgctccccgtccactcctcgtcagctcctctccaccgtcgctctcttcgccttcggcgcaggcctcctcgcctacggcgtccacctctcctacgcccacgtcgagccccagcgggcgcgcacgctcgcccgcgaccagttcgtccgcgattacctcaaaaggaagtacgacaagtagcacacggcctccccccctccccccaacgagatccccttcccgctcaatttcttgggaggggtgggggagcgatggctttggcccccgcgagctcgggcagtgggccggtggttacggaggtggagatgaacgccggcgccgaccagggtgccaccggcaccgtgcgtgccaccgtcgtgcaggcctgcaccgtgttctacgacacccctgcgactctcgataaagcagagaaactggtagctgaagcagctggatatggttcacagatagttctatttccagaagtctttgttggtggttaccctcatggatctacctttggactgactattggcaatcgatctgccaagggaaaggaagacttccataaatatcatgcagctgctatagatgtgcctggtccagaggtgacccgcttagctgcattggctggaaaatacaagattttcttggtgatgggggtggttgaaagggtagggtacacactatataatacagtgctcttctttgatcctctggggaaatacctcgggaaacaccgcaaggtcatgcctactggactggaacgagtgttttgggggtttggggatggatctactatacctgtttatgatactccaatagggaagattggtgccgtcatttgctgggaaaacagaatgccacttctcaggacagcaatgtacgctaaaggtgttcagatatactgtgctccaactgctgatttctcgcctagttggcaggcctccatgacgcatattgccgttgaagggggatgctttgtactttctgcaaaccagttttgtcgcagaaagaactatccaccagcgcctgaatatacttttggtggccttgatgaagagccatccccagaatctgttatttggcctggaggaagttccatcgtctcaccatctggaacagttctggcaggtccaaactatgaaggcgagggcctcctcacagctgacttggaccttggagaaattgctcgagctaagtttgatttcgacgtcgtgggacactatgcacgacccgaggtgctgagcctgaccgtgaaaaccgaatcaaagctgcccgtttcttttacttctgctgcagagaaaaattctgctgcaaagagtgacggtatctctaggacctgatggccattaatcttccatcgcggtgtgcaataaaattgtcagctggccagtgttggtatcacatgaataatctgtctttagtttcttgtaaagatttggagacgatgcttccctgataaacaattggtgcctatagtgctgtaatactcgtctgaaaatcgtgtcatgtttcttcctcttattcgttagtgaagacgtcccaactcccaaatgtagattgcgataacacagtactcagtattcaatttccaacaaatcatacagtattctacattccatttctaccatc

SEQ ID NO: 748 - DNA, 1950 bp, Sorghum bicolor; identical to SEQ ID NO: 400

SEQ ID NO: 749 - DNA, 1698 bp, Sorghum bicolor; identical to SEQ ID NO: 397

SEQ ID NO: 750 - DNA, 1963 bp, Sorghum bicolor; identical to SEQ ID NO: 398

SEQ ID NO: 751 - DNA, 1490 bp, Sorghum bicolor
aaaacccttttccccacaattccacaaagccgccactccccctgctgacggatggggtggtgctccccgtccacttcccggcagctcctctccacggcctccctcttcgccctcggcgcgggcctcctcgccttcggcatccacctctcctacgtccacgtcgagccccagcgcgctcgcacgctcgctcgggaccagttcgtccgcgactacctccgcaagaagcacgacaagtagcccgccgtccgtggtcgccctctcccggaccccagacccccaggcggttgcttagcagtcggagacgatggccctggccccatcgaggtccggtagcgagcctgtgatcccggaggtggagatgaatgccggcgccgaccaggccgcctcaacggtgcgggtcaccgtcgttcaggcgtcgtccgtgttctacgacacccctgcgactctcgataaagtggagaaattgatagcagaggcagctgggtatggttcacagttggttttgtttccagaagtctttgttggtggctacccacatggatctacctttggactggttatcggcaatcgaactgccaaaggaaaggaagactttcagaagtatcacgcatctgccatagatgtgcctggcccagaagtgtcccgcttatctgcattagctggaaagtttaaggtgtatctggtgataggggtggttgagagggcagggtatacactttacaacacagtgctctcctttgatccgctgggaaaatacctagggaagcaccgcaaagtcatgcctactgcattagaacgagtattctgggggtttggagatggatctacaatacctgtctatgatactccgcttggaaaaatcggtgctctcatttgctgggaaaacagaatgccacttatgaggacggccatgtatgccaaaggtattcagatatattgtgcccccacagttgattgcatgccaagttggcagtcttctatgacacatattgcccttgaagggggatgctttgtgctatcagcgagccagttctgtcaccgaaagaactatcctccccctcctgagtatacatttggtggcctagaggaagagccatccccggaatctgctgtttgttccggagggagtgtcatcatttcaccatccggaacagtgttggcaggtcccaactacgaaagtgaggcccttctcactgctgacctggaccttggagagattgttcgagccaagtttgatttcgacgtggtgggccactactcgcgacctgaggtgctgagtttggtggtgaagactgatccaaagcctgctgtctccttcacttccgcatcagagaagactaacgctggatagggcaatgacgtcttgaatacctaatgatcacatatcctatatataataacaattgcaagttgtcattgcatgaaagtagtcgcagacttctgttcagaataaactagactgacttccttaataatggccctagttttcg

SEQ ID NO: 752 - DNA, 1911 bp, Saccharum officinarum; identical to SEQ ID NO: 401

SEQ ID NO: 753 - DNA, 1551 bp, Saccharum officinarum
gcacgcgaggcgaaatgtggtgaccctgcagagaattttcccccacrattccacaaaaccgccactccccctgctgacsggatggggtggtgctccccgtccacttcccggcagctcctctctacggcctccctcttcgccctcggcgcgggcctcctcgccttcggcatccacctctcctacgtccacgtcgagccccagcgcgctcgcacgctcgctcgcgaccagttcgtccgcgactacctccgcaagaagcacgacaagtagcccgccgtccgcggccccctctcccagacccccaggcgattgcttggtagtcggagacgatggccctggccccatcgagctccggtagcgagcccgtgatcccggaggtggagatgaatgccggcgccgaccaggccgcctcaacggtacgggtcaccgtcgtgcaggcgtcgtccgtgttctacgacacccccgccactctcgataaagcagagaaattgatagcagaggcagctgggtatggttcacagttggttttgtttccagaagtctttgttggtggctacccacatggatctacctttggactggttatcggcaatcgaactgccaaaggaaaggaagactttcagaagtatcacgcatctgccatagatgtgcctggcccagaagtgtcccgcttatctgcattagctggaaaatataaggtgtacctggtgatargggtggktgagagggcargatatacactttacaacacagtgctctcctttgatccgctgggaaaatacctagggaagcaccgcaaggtcatgcctactgcactagaacgagtattctgggggtttggagacggatctacaatacctgtctatgatactccgcttggaaaaatcggtgctctcatttgctgggaaaacagaatgccacttctcaggacggccatgtatgccaaaggtatcgagatatattgtgctcccacagttgattgcatgccaagttggcagtcttctatgacgcatattgcccttgaagggggatgctttgtgctgtcagcgagccagttctgtcaccgaaagaactatcctccccctcctgagtatacatttggtggcctagaggaagagccatccccggaatctgttgtttgttccggagggagtgtcatcatttcaccatccggaacagtgttggcaggtcccractacgaaagcgaggccctgctcactgctgacctggaccttggagagattgttcgagccaagtttgatttcgacgtggtgggccactactcgcgacctgaggtgctgagtttggtggtgaaagccgatccaaagcccgccgtctycttcacttccgcatcaragaagactacgctggaaagggcaatgacgtcttgaacacctaatgatcacacstcttatatatcaattgcaagktgccattgsawgaaagtaatcgmagacttctgtcaraataaactaracmgaytccttaataatggscctaatttkcgacaaaagaaatatatatttaaattatttttgggcgggcgctttataa

SEQ ID NO: 754 - DNA, 1640 bp, Triticum sp.
gttggccctgcctttaaaatcgccgtcgccaccaaactcmccacgaatgggctggtgctccccatccgctccccggcagctgctatccaccgtcgcactctttgccttcggcgcggggctcctcacctacggcgctcacctctcctacgtccacatcgagccccagcgcgcgcgcacgctcgcccgcgatcaattcgtccgcgactacctacgcaggaagcacgacaagtaagcccgcaccccccacggcatccccctcccagtccgctcgatytctcgccgttcctgctcgtcggcgatggctttgtcccccgcgagcgtcgggccggtgatttcggaggtggagatgaacgccggcgccgatcagggtgccactaccgtgcgggccactgtcgtgcaggcctgcagcgtgttctacgacacccctgcaacgctcgataaagcagagaaattgatagcggaggctgctggatatggttcacagttggttctttttccagaagtctttgttggtggctaccctcatgggtctacctttggactgactattggcagtcgatctgccaaaggaaaagaagactttcggaagtatcatgcggctgccatagatgtgcctggcccagaggttagccgcttagctgcattggccggaaaatacaaggtcttcttggtgattggggttgttgaaagggcaggctacacactgtacaatacagtgctctcctttgattctctgggaaagtacctaggaaagcaccgcaagctcatgcctaccgcactggaacgagtattctgggggtgtggagatggatctaccatacctgtttatgatactccacttggaaaggtaggtgccgtcatctgctgggagaacagaatgccacttatcaggacagcgatgtatgccaaaggtgttcaaatatattgtgctcccactgcggatgcgctgccaagttggcaggcttccatgacacacattgcgcttgaagggggatgctttgttctgacagcaaaccagttctgccgcagaaaagactttcctcccccgcctgagtatacctttggtggccatgaggaggagccatccccagaaaccgctgtttgtcctggagggagcgccatcatctcgccatctgggacagtgttggcaggtcccaactatgaaggcgaggccctcctcacagctgacctggaccttggagaaattgttcgagccaagtttgatttcgacgtcgtgggacactacgcgcgccctgaggtgctgagcttgactgtgaagaccgaaccgaagcacgccgtgtctttcacctctactgtgggataagattcgaggcgcaaagagggacgatagtttgaagacctgatgtccagtagtcttccgtagtcgtgtataacaaagttctcgtccaacgtctttgtcggcattacaacaataattgtggcttcatatatttcttgtaaagattctctactggtttgctgttacactctcactcggtagtcaccggccgccatatatacaatttctatcaactttaacatcttagcacacagggatgtggatgcttwccgaacatcacctwcccrttgtagtttttwcwwwrawtcaaccactggtatgtacttcaccaaagaaaaaa

SEQ ID NO: 755 - DNA, 1827 bp, Zea mays
cattgggtacctcgaggccggccgggcactatcccgatcccgtcgaccctgccacatacagcctcgtttgagctctagactcgagagaggcggatagggagaggcagcaccgcagggagcagtgacagagaggccgagcgagagagagagatggacgtggagaggaaggtggtggaggcggacgacgacggccgcgtcagaacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctacttcaccgccgtcctcctgtccgactgctaccgcacgccggaccccgtccacggcaaacggaaccgcacctacatggacgtcgtccgctcatgcctcgggcctagagatgtggtggtgtgtggactcgcacagtacgcgatcctctgggggacaatggtgggctacaccatcaccactgccacgagcatcatggccgtcgcgcgcacggactgccgccaccacaggggccacgacgcggcctgcgcctcgtccgggacggtgtacatggtggcgttcggcgtcgtcgaggtggtcctgtcccagttcccgagcctggagaagctcacgatcatctccgtggtcgctgccgtcatgtcgtgcacctactccttcgtcgggctgttcctgagcgccgccaagctcgcgtcgaaccacggggcgcgcggcagcctcctcggcgtcaagatcgccgcgggcgtctccgcgtcgaccaagacgtggcactcactgcaggcactcggcaacgttgccttcgcgtacacctactccatgcttctcatagaaatccaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgcccggcagccgcaagtgggtggcgctgcaggcgctcaatgtgggcgcgctcctggtttcgctgctcgccgccgtgggctccgtggccgacatggtgcagcgcctgggccatgtcaccatctttcagacgcagctttgaaacaagtattcagattttatgcatgggaacgcgcttgcagaggcatacatcatacacatgcttgtgccgtatattcacctgtgatcttagtacattggttttggaagaacaactaaaaatggagcatgtaagtcattccacctagatttcgtgcattgcaagagtgctttttggggtgaaatagcagacagtgcacactccatgacacatttgaagcccagctaagcgttgggctgaattaatgattatgtttcttcaagggaaaaatagcacttcacatttttactcttt

SEQ ID NO: 756 - DNA, 1804 bp, Oryza sativa
ggctcaaaatcctttccgctcagataagagaggccggagactgagagagagggaaactcgtacacagagagagtatggacgtggagaaggtggagaggaaggaggtggccgtcgacgacgatggccgcgtcagaacaggaacggtatggacggcgacgacgcacgccatcaccgccgtgatcgggtcaggcgtgctggcgctgccgtggagcgtggcccagatggggtgggtgctcggccccatcgccctcgtcgtctgcgcctacatcacctactacaccgccgtcctcctctgcgactgctaccgcacgccggaccccgtccacggcaagcggaactacacctacatggacgtcgtccgctcatgcctcgggcctcgagacgtggtcgtgtgtggcattgcgcagtacgcgattctctggggcgcaatggtgggttacaccatcacgaccgctacgagcatcatgtcagtggtgcgcacgaactgccaccactacaaggggccggacgcgacctgcggctcgtccgggacgatgtacatggtgctgttcggcctcgcggaggtcgtcctgtcccagtgcccgagcctggagggggtgacgctcatctccgtcgtcgccgccgtcatgtcgttcacctactccttcgtcgggctcttcctcagcgccgctaaggtcgcgtcgcacggcgcggcgcacggcaccctcctcggcgtcagggtcggcgccggaggcgtcaccgcgtcgaccaaggcgtggcacttcctgcaggcgctcgggaacatcgccttcgcgtacacctactccatgctgctcatcgagatccaggacacggtgaagtcgccgccgtcggagaacgtgacgatgaagagggcgagcctgtacggcatcggcgtcacgaccgtcttctacgtgtcgatcgggtgcgtcgggtacgcggcgttcggcaacgccgcgcccgggaacgtcctcaccggcttcctcgagccgttctggctcgtcgacatcgccaacgttgccgtcgtcatccacctggtcggagcgtaccaggtgtacgcgcagccggtgttcgcgtgctacgagaagtggctggcgagccgttggccggagtcggcgttcttccaccgggagtacgcggtgccgctgggcggcgggcgcgcggtgcggttcacgctgtgcaagctggtgctgcgcacggcgttcgtggccgtgacgacggtggtgtcgctggtgctgccgttcttcaacgccgtgctcgggctgctcggcgccgtcgcgttctggccgctcacggtgtacttcccggtgaccatgtacatggcgcaggcgaaggtgcagagaggcagccggaagtgggtggcgctgcaggcgctcaacgtcggcgcgctcgtcgtgtcgctgctcgcggcggtgggctcggtggccgacatggcgcagcgcctgcgccacgtcaccatcttccaaacgcagctctgaacccggatggacgcatgcagccgatgagattatgcatgtagtactactcctactacttttgttgctgtactcgtactagttgctggtgtaatttggctgtcgtgttacaagctactactactagtacaagcccctctgtttttatacctctgaatttagcaaatgggacttgaggagtatggttatcctatggacaaaactgtgtacgttattccggttgggatcgtcaagcatagcatataggaatttcgggtgaaagaattcaattatgagtattagcaccttttgtatttagaacttatttctgaaagcaactaaagttaggggta

SEQ ID NO: 757 - DNA, 1797 bp, Oryza sativa
ggctcaaaatcctttccgctcagataagagaggccggagactgagagagagggaaactcgtacacagagagagtatggacgtggagaaggtggagaggaaggaggtggccgtcgacgacgatggccgcgtcagaacaggaacggtatggacggcgacgacgcacgccatcaccgccgtgatcgggtcaggcgtgctggcgctgccgtggagcgtggcccagatggggtgggtgctcggccccatcgccctcgtcgtctgcgcctacatcacctactacaccgccgtcctcctctgcgactgctaccgcacgccggaccccgtccacggcaagcggaactacacctacatggacgtcgtccgctcatgcctcgggcctcgagacgtggtcgtgtgtggcattgcgcagtacgcgattctctggggcgcaatggtgggttacaccatcacgaccgctacgagcatcatgtcagtggtgcgcacgaactgccaccactacaaggggccggacgcgacctgcggctcgtccgggacgatgtacatggtgctgttcggcctcgcggaggtcgtcctgtcccagtgcccgagcctggagggggtgacgctcatctccgtcgtcgccgccgtcatgtcgttcacctactccttcgtcgggctcttcctcagcgccgctaaggtcgcgtcgcacggcgcggcgcacggcaccctcctcggcgtcagggtcggcgccggaggcgtcaccgcgtcgaccaaggcgtggcacttcctgcaggcgctcgggaacatcgccttcgcgtacacctactccatgctgctcatcgagatccaggacacggtgaagtcgccgccgtcggagaacgtgacgatgaagagggcgagcctgtacggcatcggcgtcacgaccgtcttctacgtgtcgatcgggtgcgtcgggtacgcggcgttcggcaacgccgcgcccgggaacgtcctcaccggcttcctcgagccgttctggctcgtcgacatcgccaacgttgccgtcgtcatccacctggtcggagcgtaccaggtgtacgcgcagccggtgttcgcgtgctacgagaagtggctggcgagccgttggccggagtcggcgttcttccaccgggagtacgcggtgccgctgggcggcgggcgcgcggtgcggttcacgctgtgcaagctggtgctgcgcacggcgttcgtggccgtgacgacggtggtgtcgctggtgctgccgttcttcaacgccgtgctcgggctgctcggcgccgtcgcgttctggccgctcacggtgtacttcccggtgaccatgtacatggcgcaggcgaaggtgcagagaggcagccggaagtgggtggcgctgcaggcgctcaacgtcggcgcgctcgtcgtgtcgctgctcgcggcggtgggctcggtggccgacatggcgcagcgcctgcgccacgtcaccatcttccaaacgcagctctgaacccggatggacgcatgcagccgatgagattatgcatgtagtactactcctactacttttgttgctgtactcgtactagttgctggtgtaatttggctgtcgtgttacaagctactactactagtacaagcccctctgtttttatacctctgaatttagcaaatgggacttgaggagtatggttatcctatggacaaaactgtgtacgttattccggttgggatcgtcaagcatagcatataggaatttcgggtgaaagaattcaattatgagtattagcaccttttgtatttagaacttatttctgaaagcaactaaagtt

SEQ ID NO: 758 - DNA, 2046 bp, Zea mays
cacattactcctcttcactcactaacggccgtgcttgcactcgcagcgcatcacttgctactttggtagtggagagcagaaagaacagagctagattattcccaacaagctacagcaaattagttgctcttcatggccgtgtcacacaacgttgggagcaagcacggtgtcgcgccgctggaggtgtcggtggaggccgggaacggcggagccgccgagtggctggacgacgatggccggcctcgccgcacgggcacgttctggacggccagcgcgcacatcgtcaccgccgtcatcggctccggggtgctctcgctcgcctgggcgatcgcgcagctgggctgggtcgccggccccgccgccatgctcctcttcgccttcgtcacatactacaccgccacgctgctcgccgagtgctaccgcacgggcgacccggagacgggcaagcgcaactacacctacatggacgccgtgcgctccaacctcggcggcgccaaggtcgcgttctgcggcgtcatacagtacgccaacctcgtcggcgtcgccatcggctacaccatcgcggcgtccatcagcatgaaggccgtcaggagagctgggtgcttccacgcccacgggcacgctgatccctgcaacagctccagcaccccgtacatgatcctcttcggcgtcgtgcagatcctcttctcgcagatacccgacttcgaccagatttggtggctctccattgtcgccgccgtcatgtccttcacttactcttccatcgggctctccctcggcatcgcacagaccatctccaatggtgggttcatgggcagtctcactggcatcagcatcggcgccggtgtcacctccacgcagaagatctggcatacgcttcaggcattcggagacatcgccttcgcctactccttctccaacatcctcatcgagatccaagacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcgtcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggggggcctggactggcctgggtttggacgtatgtgcatgcagcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgtttgttgtgatgacgagtctactgtaggtgtatgaagcagcaacaaaaaaacatgttcctttctaactcttcttcttcttcttctcctcttcttctttatttacatttttcttttatgtgttttcgtctaattaaggttctggttttgtagttctaccgtgcaactcattgtaccggaaaagaatatatgaacaggaaatcccatatgatccggacgcgtgg

SEQ ID NO: 759 - DNA, 1689 bp, Zea mays
  misc_feature (925)..(925): n is a, c, g, or t
  misc_feature (995)..(995): n is a, c, g, or t
  misc_feature (1016)..(1016): n is a, c, g, or t
gatcgcgcactggggtgggtggccggccccgccgccatgctgctcttcgccttcgtcacctactacaccgccacgctgctcgccgagtgctaccgcacggggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcgcctggcccgacagcgccttcgtctcgcgggacnccgcgtgggggcccctcgccctcagcgtgttccgcctcacgtggcggtcggcgttcgtgtgcgtcaccancgtcgtggccatgctgctccncttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggctgtgctggggcctggactggcctgggtttggacgtatgtgcatgcagcattcattgcggtgcgttcaactgtggtcaacaagggagggagacggatgcagatgtttgcatggaggcccctatagaacaagtgaaaggtttaggcgcccttgtgcacatgctggtcgcattccttgcaagaataccaggggtggggccagaatggcatgagctgggtgtttgttgtgatgacgagtctactgtaggtgtatgaagcagcaacaaaaaacatgttcctttctaactcttcttcttcttcttctattcttcttctttatttacaattttcttttatgtgttttcgtctaattaaggttctggttttgtagttctaccgtgcaactcattgtacctggaaaagaatatatgaacaggaaatcccgtatg

SEQ ID NO: 760 - DNA, 1288 bp, Zea mays; identical to SEQ ID NO: 104
  misc_feature (69)..(69): n is a, c, g, or t
  misc_feature (323)..(323): n is a, c, g, or t
  misc_feature (372)..(372): n is a, c, g, or t
  misc_feature (558)..(558): n is a, c, g, or t
  misc_feature (585)..(585): n is a, c, g, or t
  misc_feature (598)..(598): n is a, c, g, or t
  misc_feature (613)..(613): n is a, c, g, or t
  misc_feature (624)..(624): n is a, c, g, or t
  misc_feature (632)..(632): n is a, c, g, or t
  misc_feature (673)..(673): n is a, c, g, or t
  misc_feature (923)..(923): n is a, c, g, or t
  misc_feature (993)..(993): n is a, c, g, or t
  misc_feature (1014)..(1014): n is a, c, g, or t
  misc_feature (1149)..(1149): n is a, c, g, or t
  misc_feature (1155)..(1155): n is a, c, g, or t
  misc_feature (1165)..(1165): n is a, c, g, or t
  misc_feature (1192)..(1192): n is a, c, g, or t
  misc_feature (1218)..(1218): n is a, c, g, or t
  misc_feature (1244)..(1244): n is a, c, g, or t
  misc_feature (1255)..(1255): n is a, c, g, or t

SEQ ID NO: 761 - DNA, 1548 bp, Arabidopsis thaliana
accatttcctcttcaccggggaaaattctgttagtttctttctccggtagttgaaagaaaatgtctcctgcgatcaaagcaccgctcttaccaaaccaagagccttcatcatcatcatcggagaaccatggatcattcgccggagctgtgtttaacatctcgacaagcatcgtcggagctggaattatggcgattccggcggctttcaaagtcctaggtgtaatcccatctctatcgataatcgtaatcatagcttggctctccaatgtatcagctgggtttttaatgaaatccagtctcgccggagaatcaacaacttacgccggcgtgatgaaggaatcgttcggaaaatctggtgccgttgctgttacggttgttacaatggttgtgacttttgggtctatgattattttctcgattatcattggtgatgttatttcgggtaatgagaaagatggaatcatacatttaggtcttcttcaagaatggtttggttctcattggtggaatacgagattctttggtttgttgttcatctttgtcttcctcttccttcctttagtcttatgcagacgtgtagaaagattggcatttagttctgcaatttcgtttctgcttgcgttactctttgttggcataagctcggggttagcgattattgctctcgtgcaagggaagacaaagcctccgagactcttccctgaactcaatgatggtggattatcgtttttcagtctcttcactgcttcccctgtcattgtaacagccttcacctttcatttcaatgtccatccagtagcattcgaactcaaagatccattaaatgtgctttcagcaacaaggatctctgtgattctgtgtgctacgatctactcagctactggtctcttttgttaccttctgtttggggattccactatgacagatgttctaatgaactttgatcaaagcaccagttcttcggttggttcattactaaatgatattgttagactcagctacgcgattcacctcatgctcgtgtttcctctgctcaacttctcgcttagagccaacctcgacgaactcttgttccctatgaagctttctttagtggaagacaacaaaagattcttcgcactcacttttccattactgatatcttgtttcttgggtgcaattgccataccagacatttggtacttctttcagttcttgggatcaacttctacagtctctatagcattcatctttccagctgcaattctcctacggaatgtaaatggtttctcgactttaagagagaagattgtagcttcagtaatgcttgttcttgctgttgccacaagtatcatcgctatttcgacaaatatatacactttcacagcaacagaagaaacatgaaacgctttcctggagtcctttctccttcaaggatttgttagatggtagagcttgtgttgcatttattcatgtctattgtatgtaaaataggtttgtaagaagtgtattataatagcaacttcaggaaaaatgtgtgtataagattgaagcagagttttaactttt

SEQ ID NO: 762 - DNA, 1633 bp, Arabidopsis thaliana
caattttcagttttcattaccatttcctcttcaccggggaaaattctgttagtttctttctccggtagttgaaagaaaatgtctcctgcgatcaaagcaccgctcttaccaaaccaagagccttcatcatcatcatcggagaaccatggatcattcgccggagctgtgtttaacatctcgacaagcatcgtcggagctggaattatggcgattccggcggctttcaaagtcctaggtgtaatcccatctctatcgataatcgtaatcatagcttggctctccaatgtatcagctgggtttttaatgaaatccagtctcgccggagaatcaacaacttacgccggcgtgatgaaggaatcgttcggaaaatctggtgccgttgctgttacggttgttacaatggttgtgacttttgggtctatgattattttctcgattatcattggtgatgttatttcgggtaatgagaaagatggaatcatacatttaggtcttcttcaagaatggtttggttctcattggtggaatacgagattctttggtttgttgttcatctttgtcttcctcttccttcctttagtcttatgcagacgtgtagaaagattggcatttagttctgcaatttcgtttctgcttgcgttactctttgttgtcataagctcggtgttagcgattattgctctcgtgcaagggaagacaaagcctccgagactcttccctgaactcaatgatggtggattatcgtttttcagtctcttcactgcttcccctgtcattgtaacagccttcacctttcatttcaatgtccatccagtagcattcgaactcaaagatccattaaatgtgctttcagcaacaaggatctctgtgattctgtgtgctacgatctactcagctactggtctcttttgttaccttctgtttggggattccactatgacagatgttctaatgaactttgatcaaagcaccagttcttcggttggttcattactaaatgatattgttagactcagctacgcgattcacctcatgctcgtgtttcctctgctcaacttctcgcttagagccaacctcgacgaactcttgttccctatgaagctttctttagtggaagacaacaaaagattcttcgcactcacttttccattactgatatcttgtttcttgggtgcaattgccataccagacatttggtacttctttcagttcttgggatcaacttctacagtctctatagcattcatctttccagctgcaattgtcctacggaatgtaaatggtttctcgactttaagagagaagattgtagcttcagtaatgcttgttcttgctgttgccacaagtatcatcgctatttcgacaaatatatacactttcacagcaacagaagaaacatgaaacgctttctggagtcctttctcttcaaggatttgttagatggtagagcttgtgttgcatttattcatgtctattgtatgtaaaataggtttgtaagaagtgtattataatagcaacttcaggaaaaatgtgtgtataagattgaagcagagttttaacttttaagcaccaacactcactatgctttatgtctcgtaaaatgacatttaagtacaaaatttaactttttgtt

SEQ ID NO: 763 - DNA, 2021 bp, Arabidopsis thaliana
actttttcgtctagatacattcttcgtgaagaaatccaagtgcacacattcattagtgttggacggacccattttattttggatttttttgtataattctttggggtttttttgttaataattcacttctgtctataatatgattatgattgttcatcatattttagctgtaatttcctctcttgaacaaaattattattttcgtgatgtttttaagtacgtgacgaaagatcatttggtgatctcactgacatgatttgcccagcctgtcaggtttacctatggtcaaatatcattttctcgattttgccccaaacggtcaaggcatatatccccaatcttcaaagggtatttatgtacttttcgctattaaccgtgtggctatatgaagccgattcctcataacaactacaaaaaaggaaagcttcttcccgccggcaaattcttacgtttctccggcggttagaaaaatgacaccacagatcaaaactcatctcttgccgaagcaagaaccttcttcgtctgagaaccatggatcatcaacctccggcatcgttttcaacgtgtcaacgagtataatcggagccggaataatgtcgatgccggcggcgtttaaagttcttggaatagttccagcgtttttgattatcacgatcatagcttggctttccacaatttccgttggatttctgatgaaatcaactctcgccggagaatcaactacttacgccggagttatgaaagagtcgtttggtaaaacaggatccatcgctgtacagattgctacgatggttgctacttttggttgtatgattatattttcgattattataggagatgtgctttctggtaatgaaaatggtggtcctgaacatattggagttttgcaagaatggtttggttcttactggtggaacacgagaatcttcgctttgttatttgtctacggctttgtcttgcttccattggtcctgcgtagacgagtcgaaagactggcaattagttccgctgtatcgtttcttcttgcggttctatttgttgtcataagctcggtgctggcgatttccgcgctggtgaatggacaaacgaagaatccaagactgtttccggagttgagcaatggaggatcgttctggcaactcttcacagcttcccctgttatagttacagccttcacgtttcacttcaatgttcatccaattggattcgagctcaaagatccattacaagtgatcccagcaactaagatctctgtcatcttgtgtgctgctatctacttcgcaactggactctttggttaccttctctttggagatgcaactatgtcggatattctagtgaactttgaccagagctctggttcttccattggttctcttctcaacgacattgtcagactcagctacgtgcttcacctcatgctggtctttcctctcctgaacttctcattgagagcaaatctcgacgaactcttgtaccccaagaagccgtccttggaaaaagacacaaaaagattcatcggactcactctggctctactgatttgctgtttcttgtctgcaatcgctgtaccagacatttggtacttctttcagttcatgggatcaaccatcacagtctccatagcattcatatttccagccgccattgttctaaggaatatccatggtgtatcaacctcaagagagaagatcgtagctgcaataatgcttgttcttgctgttgccactagcattattgctatctcgacaaatttatacagcctcgcagcaaactagtcgttgaaaaaagttttgcaaacagtcccttccatgatcacttcaaagaaatctgtaaaattattagcttgccgtagcattcatatttatatctttgtgaaataggtttgtcagaaaatgcaatgtaatagctatacaaagtgcaatttttgttgctgcttgaaacagagaaagaggaaatgaacaactcttcaaaacttgtattctttaaattactttttgtagaccattatttgaatgaac

SEQ ID NO: 764 - DNA, 1941 bp, Arabidopsis thaliana
accacacaaacatatacaacacacccaatcagagatcgatcgccattaacgtagactgtgactctcggctcttcttcactctcaatttcgatcggcatgaggtacgatcaggaagcgggatcgtcctcccattcgctgccttcgggatcatcctcccattcgctgccgccgacggaagacactcctcttttggggcctcgaacattgtcgtcgcagccaaaaacctttgcaaatgtcttcatcgccatcgtcggcgccggcgtgctcggacttccgtacaccttcaagaagactggatggctcttgggcctcctcacactcctcttcgtatcctccctcaccttcttctgtatgatgctcctcgtccacacccgccggaaactcgagtccctctccggcttcaacagcatcacttctttcggagatctcggcgaatccgtctgcggccctgccggtcgtctcgtcgtcgatgttatgcttgtcctttcccaatctggcttctgcgtcagttaccttatcttcgtcgccaccacaatggctaatctcctcagccgcggcaccgaacatattctaggcctcgatgctgcttccatttacctctggggatgtttcccctttcagctgggtctcaactccatcccatcgctcacccatctcgcccctttgagtatattcgccgatatcgtggacgtagccgccaccttagtggttatggtgcaggatgttttcatcttcctgaaacgaagacctcctttgagagtctttggaggtgtctctgttttcttctacggattgggagttgcggtgtacgcatttgaagggatcggaatggttctgccactggaactagaggctaaatacaaagacaagttcggtagagcgctggggctagccatgggcttaatctcgatcatgtacggtgcgttcgggctgctagggtacatggcttacggagaggagacgaaagacatcatcaccaccaacctggggacaggagtggtgagcactctggtgcagctgggcttagcaatcaacctcttcttcacattcccccttatgatgcaacctgtctacgaggtcgtggaacgccgcctttgcagctcccgttactctgtatgggtgcgctgggccactgtgctggtggtcacgctcgtggccctgctcgtcccaaattttgcagacttcttatctctggtggggagcagcgtctgcgtggtgctgggctttgtcttgccatcactatttcacttgcaggctttcaaaaacgagttgagcatcacaagaatagtggtagacgttctcgttttcctcattggtgttatgatagccattaccgggacctggactgcagtacatgagatcctgacatccaaggcctgagcttcttccattgtttatttttgtcagtatgaaaagagaagcattgttacctccagcgaacacggcattattattgttattctgttactctcctcacttgtttatttgagtcttattactctatttgtaagaaagacgcaccatggaaaaccaataagaaaaatactcttagaatcaagtttgataaacaccatttgcggctattcgcaacaaagagactaaatcaaaactgcagaagccaaatcatttggactttggcctccctctttttctagtcacctgaatctcttcttttgctccttctccattaacagattcgttcagtctatcggtatctaactccatgccaaggccatcgaattccaccctcttggaaacggcatgctctgtattcagcctctctcttgagcatgtgggaaccgcacactggtcgtcgttcttatgttgacaactcgaagaagagtttgaaactatgccctgactgacgacgcctccaagttgcaacttggagggtaatgcatcatccttggaaaacaacaagtcagcagcaacatgcttctt

SEQ ID NO: 765 - DNA, 2469 bp, Arabidopsis thaliana
tactctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatctatggatcaaaaagttagacagtttgaggtttgcactcaagacggtagcgttgatcgtcacggcaatccagctatccgagctaataccggcaaatggctcactgctattctcattctagtgaatcaaggactagctacgcttgcgttcttcggtgtaggagtgaatttggttctgtttctgactcgagtgatgggacaagacaatgcagaagcggctaataatgttagtaaatggacaggaactgtctatatcttctctttgcttggtgctttcctcagtgactcttattggggacgttacaagacttgtgctatctttcaagcaagtttcgttgcagggttgatgatgttatctttatctactggtgcgttattgcttgaaccaagtggttgtggagttgaagattcgccgtgtaagcctcattcgacgtttaagacggttctgttttatctgtcggtgtatctaatcgcgttagggtatggtggttatcagccgaacatagctacttttggagctgatcagtttgatgcggaggattccgttgaaggacactcgaaaatcgcgtttttcagttacttttacttggctctgaatcttggatcgctcttctcaaatactgtcttgggttactttgaggatcaaggggaatggccgcttggattttgggcgtctgctggctctgcttttgcggggttagtgcttttcttgattggcacgccaaagtaccgacactttacgcctagagagagtccttggtctagattctgccaagtgttggttgctgcaacaagaaaggctaagattgatgtgcaccatgaagagttgaatctctatgattctgagactcaatacactggagataagaagattcttcataccaaaggcttcagattcttggatagagctgctattgttacacctgatgatgaggctgagaaagtagagagcggatcgaaatacgatccatggaggctctgctcggtgactcaagtcgaagaagtgaaatgtgtattaagactcttaccaatctggctctgcaccatcctctactctgtggttttcacccaaatggcttcactgttcgttgtgcaaggagcagcgatgaagacaaacatcaaaaacttccggattccagcttcaagcatgtctagtttcgacattctcagtgtcgccttcttcatcttcgcatacaggcggtttcttgatccactctttgcaagacttaacaaaacagaacgcaacaaaggtctcactgagcttcagaggatggggattgggcttgtgattgcgataatggcgatgatttccgcaggaatcgtagagatacacagactgaaaaataaggaaccggaaagtgctacttcgatctcaagctccagcactttgagcattttttggcaagtacctcagtacatgttgataggtgcatcagaagtgttcatgtacgttggtcaactcgagttcttcaacagccaagcaccaaccgggctaaagagctttgcaagcgcgctatgtatggcttcaatatctcttgggaactatgtaagcagtttgttagtttccattgtcatgaagatctctacaacagatgatgtgcatggctggattcctgaaaatctcaacaaaggacacttggagagattctacttccttttagctggtctaaccgctgctgatttcgtggtttacttgatttgtgccaaatggtacaagtatattaaatctgaagcaagtttctctgagtccgtaactgaagaggaggaagtctgagtcaggagctagagagttttgtgttttattttaatgctgtgaagctttttacagtaatttgtttaaagctgagcttgttctgtgatataaactggtcttattgtgtttttatttttgggttatactcttgtgcaaagtttagttgatgtttctcaataaaggataagttgattccacagttccaacacatagtttatgtaacttttctcataacctttgaatcagtcaaaacctaaacacttactagtagaacagtaaaaatttacaatattaaatcaagctcttaatgttgtagtgaaaacaaggactgttaactatggaaactgcagaaaaagctttgtggaaacttaacagcctgagaacaagctaaacgttcatccttaggtcttatctttgtggccactcgagctgatgcttcaactcaagagtttctatgatacaaaaatcgcgaaccgcctcaaattgttgttacatcaatacaagagaggcaactctcgctgtcttgatca

SEQ ID NO: 766 - DNA, 2159 bp, Arabidopsis thaliana
agagagacggagaacaagagcaatcaaatcacacaaatcctcgaaaaagtaaaattcttgattaaaaaaaaacggacattttgtgctcagacactcagctttccttattagtcttttgccacctctctgcaaagttctcgaacccactctgtaaccaaaatcaatcataaagatttgatctttttttttcctttttcggtgagatttaatcctctaaggttcttgatactctctagatctattcttacttgggtttgttcgaaatatggaggacaagaacaatgataaggagaaaaaaaccgacgttacgttcgaagatgacgaagataacgaagatctagaagacaacagcagtaagtacgagaacgacagtgaaactgatcaaagcgatctcggagatcttcctggtgatgctgttgatcgtgacgacgacatcgatgaacctttcatttcccaggttcaatggcctcaaagcttcagggaaacgactgattcttatacgattgcggcatcaccaatcttcgggtcgctcaggagtaatcctccgagtttctatagagccagcagaagtaatttagatgttgagtcaaaagcacctttgcttcctgagaggcatgatgattcagacaaagcctcagctacacaatctgcttggtctcataaaggctcatttgctgaggaattgcccattggtggctatggatgcagcgtcattcaaaccattttcaatgctattaatgtaatggctggagttggacttctctcaacaccttatacagtgaaagaagctggttgggcaagtatggtaattcttctcttatttgctgttatttgttgttacactgctactttaatgaaagactgtttcgagaacaagaccggcattatcacttatcctgatattggagaagcagcttttggcaaatatggtcgtattcttatctgtatgctattgtacacagaactatattcatattgtgttgaattcatcattttggaaggagataaccttaccgggcttttccctggtacatccttggatttgctcgggttccgacttgactctaagcatttatttggaatcttaactgctctcattgttcttccaactgtttggttgaaagatctacgcatcatttcctacctctcagccggtggagttatcgcaaccgctttgatagcagtaagcgtgtttttcctcggtacaacgggcgggattgggtttcatcacaccgggcaggctgtgaaatggaacgggataccgtttgcaattggtatatacgggttttgctattcaggacattcagtgttcccaaatatataccaatccatggctgataaaaccaaattcaacaaagcagtgatcacttgtttcattatatgtgttttgttatacggaggagttgcaatcatgggttatctcatgtttggagaagctaccttgtctcagattacactaaacatgccacaggaccaatttttctcaaaagtggcacagtggacaacggttgtgagtccgtttacaaaatacgctctcctgatgaatccacttgcaaggagtatagaagaactattaccggaaagaatgtcagagaacatatggtgctttcttcttctaagaacagcactcgtcgcttcttctgtttgttctgctttccttattccattttttggtcttatgatggctcttataggatctcttctcagtatactagtggcaataataatgccagctttatgcttcataaagataatggggaacaaagcaacaagaacacagatgattctgagttcgatcattgtggccatcggggtggtaagcgggaccttggggacatattcttcggtggcaaagatcattaggaactatcagtgaaggaactccatgacaaagagacccatagtttatcccctgtactttgagttgaatgtttttgttgaagctaataaactcttgattatgaaagattattttggacttgaaagttaataaaactagtgaaaggtttactttctcataggtgtcacatttgcttttgtatttttgtgtatctactatctcttcatttttctgagcatctttctcatgtttagatttgggtataatgagctcgcctatttgataaaggcattaataataagtattaacaacacaaata

SEQ ID NO: 767 - DNA, 1378 bp, Arabidopsis thaliana
ggcgttttcttcttccttcatagatagcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtatttatttagtgcaa

SEQ ID NO: 768 - protein, 133 aa, Zea mays; identical to SEQ ID NO: 110

SEQ ID NO: 769 - protein, 133 aa, Oryza sativa; identical to SEQ ID NO: 111

SEQ ID NO: 770 - protein, 124 aa, Sorghum bicolor
MAARAALILAVSLVLAAVASATYCPPPPAPKPPTPTPSGHHCPRDSLKLGVCANVLGLVKAKIGSPPYQPCCSLLDGLVDLEAAVCLCTAIKANILGINLNLPIDLSLILNNCGKNCPNDFHCA

SEQ ID NO: 771 - protein, 124 aa, Saccharum officinarum; identical to SEQ ID NO: 770

SEQ ID NO: 772 - protein, 124 aa, Triticum sp.; identical to SEQ ID NO: 770

SEQ ID NO: 773 - protein, 109 aa, Triticum sp.
MAARAALLQLAVSLVILAAVASASATDCPPPPLPPAPKPPTPGGHHGHGSCPRNALKLGVCANVLGLGEGQGRLAAVRAVLLAAGRARRPGGRRLPLHRRQGQHPRHQP

SEQ ID NO: 774 - protein, 66 aa, Zea mays
MGQCSSSQHPEAEQQKQQKQAACVDIQKRQEQLRQKAAAHMNQPYQASSNDELVLLVSLDSITKIG

SEQ ID NO: 775 - protein, 66 aa, Zea mays; identical to SEQ ID NO: 113

SEQ ID NO: 776 - protein, 52 aa, Zea mays
MGQCSSSQHPEAEQQKQQQAAACVDIQKRFLQTTVFLAYIYSRRATQTMHGG

SEQ ID NO: 777 - protein, 66 aa, Sorghum bicolor
MGQCSSSSQHPKAEQKQQPAAGVDTQKRQEQLRKAAAAAHMNQPYHASSNEELVLLVSLDSITKIG

SEQ ID NO: 778 - protein, 86 aa, Sorghum bicolor
MVASTSADGAREREREREREMGQCSSSSQHPKAEQKQQPAAGVDTQKRQEQLRKAAAAAHMNQPYHASSNEELVLLVSLDSITKIG

SEQ ID NO: 779 - protein, 86 aa, Sorghum bicolor; identical to SEQ ID NO: 778

SEQ ID NO: 780 - protein, 66 aa, Triticum sp.; identical to SEQ ID NO: 113

SEQ ID NO: 781 - protein, 101 aa, Zea mays
MTKPSQVLLAALAAWAVVLLLLCAAAPRGADAATACDATQLTPCAGAIIIGRSPSAACCSRLKEQQPCLCTYARDPNLQRYVNSPNGKKAMAACKVPVPSC

SEQ ID NO: 782 - protein, 101 aa, Zea mays
MAKPSQVLVSALAAWAVVLLLLCAAAPRGADAATACDAAQLTPCAGAIIGSSPPTAACCSRLREQQPCLCTYARDPKLQRYVSSPNGKNAMAACKVPVPSC

SEQ ID NO: 783 - protein, 102 aa, Zea mays
  misc_feature (4)..(4): Xaa can be any naturally occurring amino acid
MCGXFVPPFSELHLTHLQPSLLLCAAAPRGADAATACDATQLTPCAGAIIIGRSPSAACCSRLKEQQPCLCTYARDPNLQRYVNSPNGKKAMAACKVPVPSC

SEQ ID NO: 784 - protein, 101 aa, Zea mays; identical to SEQ ID NO: 114

SEQ ID NO: 785 - protein, 97 aa, Sorghum bicolor
MATKPAQVLVAVVVLLLLCAATPRGADAATACDATQLTPCAGAIIGSSPPTAACCSRLKEQQPCLCTYARDPNLQRYVNSPNGKKAMAACKVPVPSC

SEQ ID NO: 786 - protein, 97 aa, Sorghum bicolor; identical to SEQ ID NO: 785

SEQ ID NO: 787 - protein, 102 aa, Saccharum officinarum
MATKPSQVLLAALAAWAVVLLLLCAAAPRGADAATACDATQLTPCAGAIIGNSPPTAACCSRLKEQQPCLCTYARDPKLQRYVNSPNGKNAMATCKVPMPSC

SEQ ID NO: 788 - protein, 101 aa, Triticum sp.; identical to SEQ ID NO: 782

SEQ ID NO: 789 - protein, 171 aa, Zea mays
MAMPRAPGAGSLRFLGLLKQPESDAAAPFELDERDVLWPTGGGQQDGWAAPPARRRRAHAMPLYSFGLSSLLAEDCGGGVPVPVPGRAMAMAPSAAPRQSAPVRVPAPWPGGRRADEDEEDGEEVVPPHVVAARRHARSSSVLEGAGRTLKGRDLRSVRNAVLRQTGFLDL

SEQ ID NO: 790 - protein, 126 aa, Hordeum vulgare
MTSMLSAFSQWFVNPRRNPLARIHMLTISNRLKNYGLRYDDLYDPYFDLDIKEALTRLPREVVDARHQRLKRAMDLSMKHQYLPDDVRALQTPFKSYLSDMLALVKKEAAERKALGALPLYERTLP

SEQ ID NO: 791 - protein, 126 aa, Hordeum vulgare; identical to SEQ ID NO: 790

SEQ ID NO: 792 - protein, 122 aa, Gossypium sp.
MSSFLQSLLDPKKSWLASLHMKALTTRLRKYGLRYDDLYDPYYDLDIKEALNRLPREIVDARNQRLKRAMDLSMKHEYLPEDLQKMQTPFRSYLQDMLALVKKERAEREALGALPLYQRTIP

SEQ ID NO: 793 - protein, 122 aa, Gossypium sp.; identical to SEQ ID NO: 792

SEQ ID NO: 794 - protein, 126 aa, Zea mays
MTSMLSAFSSWFVNPRRNPLARIHMLTISNRLKNYGLRYDDLYDPYFDLDIKEALGRLPREVVDARHQRLKRAMDLSMKHQYLPDDVRALQTPFKSYLSDMLALVKKEAAERKALGALPLYERTLP

SEQ ID NO: 795 - protein, 123 aa, Zea mays
MLSKLSAWFVNPRRNPLARLHRNAVASRLRKYGLRYDDLYDPYHDLDIKEALARLPREVVDARNQRLKRAMDLSMKHQYLPDDVQAIQTPFRSYLFDMLALVKKESAEREALGALPLYQRTIP

SEQ ID NO: 796 - protein, 123 aa, Zea mays; identical to SEQ ID NO: 795

SEQ ID NO: 797 - protein, 126 aa, Zea mays
MSSMMNALSNWLVNPRRNPLARLHMHAVSSRLRKYGLRYDDLYDPYFDLDIKEALGRLPREVVDARIQRLKRAMDLSMKHQYLPEDLQAQQVPFRGYLSDMLALVKKENAEREALGALPLYQRTLP

SEQ ID NO: 798 - protein, 126 aa, Zea mays
MSSMMNALANWLENPRRNPLARLHMHAVSSRLRKYGLRYDDLYDPYFDLDIKEALGRLPREVVDARIQRLKRAMDLSMKHQYLPEDLQAQQVPFRGYLGDMLALVKKESAERQSLGALPLYQRTLP

SEQ ID NO: 799 - protein, 126 aa, Zea mays; identical to SEQ ID NO: 118

SEQ ID NO: 800 - protein, 126 aa, Oryza sativa
MSSMLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERLEREELGALPLHQRTLP

SEQ ID NO: 801 - protein, 194 aa, Oryza sativa
MGPPPSSAHLAYYNSQIWLIFPNPPYDLGPRLVSSLFPPQKRGREGGRRRRREGREGEIAGSPPAAATMSSMLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERLEREELGALPLHQRTLP

SEQ ID NO: 802 - protein, 186 aa, Oryza sativa
MGRPIGPSPSNVPQASRPNPNHPKPSNRTVSSLVKPNPSKAPATSEKRERERESVEASGRFSKMLSSLSAWLVNPRRNPLARLHMNAVASRLRKYGLRYDDLYDPYHDLDIKEALARLPREVVDARNQRLKRAMDLSMKHQYLPADAQAKQTPFRGYLSDMLALVKKESAEREALGALPLYQRTIP

SEQ ID NO: 803 - protein, 126 aa, Oryza sativa
MSKMLSSLSAWLVNPRRNPLARLHMNAVASRLRKYGLRYDDLYDPYHDLDIKEALARLPREVVDARNQRLKRAMDLSMKHQYLPADAQAKQTPFRGYLSDMLALVKKESAEREALGALPLYQRTIP

SEQ ID NO: 804 - protein, 123 aa, Sesamum indicum
  misc_feature (115)..(115): Xaa can be any naturally occurring amino acid
MAAALSKWLVDPKRNPLAALHMKTLSNRLSKYGLRYDDLYDPMYDLDVKEALNRLPKEVVDARNQRLKRAMDLSMKHDYLPEDLQAMQTPFRSYLQEMLALIKKENAEREALGAXPLYQRTIP

SEQ ID NO: 805 - protein, 123 aa, Sesamum indicum
MASALTKWLVDPNRNPLAALHMKTLSKRLRKYGLRYDDLYDPMYDLDVKEALNRLPREIVDARNQRLKRAMDLSMKHEYLPEDLQAMQTPFRSYLQEMLALVKRENAEREALGALPLYQRTIP

SEQ ID NO: 806 - protein, 123 aa, Sorghum bicolor
MLSKLSAWFLNPRRNPLARLHRNAIASRLRKYGLRYDDLYDPYHDLDIKEALARLPREVVDARNQRLKRAMDLSMKHKYLPDDVQAIQTPFRSYLSDMLALVKKESAEREALGALPLYQRTIP

SEQ ID NO: 807 - protein, 126 aa, Sorghum bicolor
MSSMMNALANWLVNPRRNPLARLHMHAVSSRLRKYGLRYDDLYDPYFDVEIKEALGRLPREVIDARIQRLKRAMDLSMKHQYLPEHVQAQQVPFRGYLSDMLALVKKENAEREALGALPLYQRTLP

SEQ ID NO: 808 - protein, 126 aa, Sorghum bicolor; identical to SEQ ID NO: 807

SEQ ID NO: 809 - protein, 123 aa, Saccharum officinarum
MLSKLSAWFVNPRRNPLARLHRNAVASRLRKYGLRYDDLYDPYHDLDIKEALARLPREVVDARNQRLKRAMDLSMKHKYLPDDLQAIQTPFRSYLSDMLALVKKESAEREALGALPLYQRTIP

SEQ ID NO: 810 - protein, 126 aa, Saccharum officinarum
MSSLMNALSNWLVNPRRNPLARLHMHAVSSRLRKYGLRYDDLYDPYFDLDIKEALGRLPREVVDARIQRLKRAMDLSMKHQYLPEHLQAQQVPFRGYLSDMLALVKKENAEREALGALPLYQRTLP

SEQ ID NO: 811 - protein, 123 aa, Nicotiana sp.
MASTFSKWLVDPKKNPLAAIHKKSLSARLRNYGLRYDDLHDPMYDLDVKEALNRLPREIVDARIQRLKRAMDLSMKHQYLPEDLQAMQTPFRSYLQEMLALVKRERAEREALGALPLYQRTIP

SEQ ID NO: 812 - protein, 123 aa, Nicotiana sp.; identical to SEQ ID NO: 811

SEQ ID NO: 813 - protein, 123 aa, Nicotiana sp.; identical to SEQ ID NO: 811

SEQ ID NO: 814 - protein, 194 aa, Triticum sp.
MPWQQQEVEVYTLLRQQAASGGRQQEQRQRQLLLVFPFPSPLLFGGGGFRKSRDRARGSPPPPPPSPRMTSMLSAFSSWFVNPRRNPLARIHMLTISNRLKNYGLRYDDLYDPYFDLDIKEALCRLPREVVDARHQRLKRAMDLSMKHQYLPDDVRALQTPFKSYLSDMLALVKKEAAERKALGALPLYERTLP

SEQ ID NO: 815 - protein, 126 aa, Triticum sp.
MTSMLSAFSSWFVNPRRNPLARIHMLTISNRLKNFGLRYDDLYDPYFDLDIKEALGRLPREVVDARHQRLKRAMDLSMKHQYLPDDVRALQTPFKSYLSDMLALVKKEAAERKALGALPLYERTLP

SEQ ID NO: 816 - protein, 126 aa, Triticum sp.
MTSMLSAFSSWFVNPRRNPLARIHMLTISNRLKNYGLRYDDLYDPYFDLDIKEALCRLPREVVDARHQRLKRAMDLSMKHQYLPDDVRALQTPFKSYLSDMLALVKKEAAERKALGALPLYERTLP

SEQ ID NO: 817 - protein, 126 aa, Triticum sp.; identical to SEQ ID NO: 794

SEQ ID NO: 818 - protein, 110 aa, Triticum sp.
MSSMLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERL

SEQ ID NO: 819 - protein, 163 aa, Hordeum vulgare
MAQRDHKQEEPTELRAPEITLCANSCGFPGNPATQNLCQNCFLAGPASTSPSSSSSSLPGASVSTPVLDRPRPAPVDAELAHPAVDYRATATEAKPARTSVNRCSSCRKRVGLTGFRCRCGDVFCGEHRYSDRHGCSYDYKAAARDAIARDNPVVRAAKIVRF

SEQ ID NO: 820 - protein, 161 aa, Zea mays; identical to SEQ ID NO: 178

SEQ ID NO: 821 - protein, 161 aa, Zea mays; identical to SEQ ID NO: 178

SEQ ID NO: 822 - protein, 163 aa, Zea mays; identical to SEQ ID NO: 120

SEQ ID NO: 823 - protein, 196 aa, Oryza sativa
MAEGLANPFPKAKRTYARFVSLSDSIMAQREKKVEEPTELRAPEMTLCANSCGFPGNPATNNLCQNCFLAASASSSSSSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIAREKPVCRAGKNRKF

SEQ ID NO: 824 - protein, 176 aa, Sorghum bicolor; identical to SEQ ID NO: 121

SEQ ID NO: 825 - protein, 176 aa, Sorghum bicolor; identical to SEQ ID NO: 121

SEQ ID NO: 826 - protein, 172 aa, Sorghum bicolor
MAQRDKKEEPTELRAPEITLCANNCGFPGNPATQNLCQSCFSAATASRSSSPSSPTSSSSASAVSQPRPAALVDAAAVELLASADAAAVGQSMEVVAAAPAATAARSSAVNRCSSCRKRVGLTGFRCRCGELFCGAHRYSDRHDCCFDYKAVGRDAIARENPVVRAAKIVRF

SEQ ID NO: 827 - protein, 172 aa, Sorghum bicolor
MAQRDKKEEPTELRAPEITLCANNCGFPGNPATQNLCQSCFSAATASRSSSPSSPTSSSSASAVSQPRPAALVDAAAVELLASADAAAVGQSMEVVAAAPAATAARSSAVNRCSSCRKRVGLTGFRCRCGELFCGAHRYSDRHGCSYDYKGAGRDAIARENPVVRAAKIVRF

SEQ ID NO: 828 - protein, 172 aa, Sorghum bicolor; identical to SEQ ID NO: 827

SEQ ID NO: 829 - protein, 73 aa, Zea mays
MSTTTPTNAASQQGDDAAAGRADKKPAQETVTKTVQTVEVRSSAGQPDEEGVLKPVKVVHEIPAKDSSGVKQD

SEQ ID NO: 830 - protein, 70 aa, Sorghum bicolor; identical to SEQ ID NO: 123

SEQ ID NO: 831 - protein, 170 aa, Zea mays
MGICVSCDAADEGAATARVVLPSGELREYAPPATAGTALQAAGGEGPWLLCDADGMAFEGPVAVAAVAPGEELQAGQIYFVLPAEMRRRRLTREEVAALAVRASSALVKAAQPSSPCRRLRRGAVAPLVFPVPEEEYAAADAVSPVARRSRTRSGGWRAGAGGRPGSPPT

SEQ ID NO: 832 - protein, 188 aa, Sorghum bicolor
MGICMSSDAADEGAATARVVLPSGELREYAPPATAATALQAASGGDGEGSSWFLCDADGIAFEGGPVAVAAVAPGEELQAGQIYFVLPAEMQRRRLTRDEVAALAVRASSALVKAAAAQPSSPCRRRRRGAVAPLVFPVPEEEYAAAEPVSPVAAKSAVAAAQKRRVAYRGGRASRFSPDLTAIPETE

SEQ ID NO: 833 - protein, 89 aa, Zea mays
MVLSGGLVVPWLAAAVRGSRRWPRWPSPPPRSAPMPTRTTPSAMTRAGTTASACPGSTTRRGLTARTSASGISSSSTRTRTTRWCRRGT

SEQ ID NO: 834 - protein, 129 aa, Zea mays
MAPKVALFLALSLLFAATAHGCEPNCSGPVVPTPPVVPTPSSHSHGRCPIDALKLKVCANVLGLVKVGLPQYEQCCPLLEGLVDLDAALCLCTAIKANVLGIHLNVPLSLNLILNNCGRICPEDFTCPN

SEQ ID NO: 835 - protein, 85 aa, Zea mays
MAPKVALFLALSLLFAATAHGCEPYCSGPVVPTPPVVPTPSSHSHGRCPIDALKLKVCANVLGLVKVGLPQYEQCCPLLEGLGDP

SEQ ID NO: 836 - protein, 108 aa, Zea mays
MAPKVALFLALGPSLRCRREWLRTLLSRPSRPNTASRADTVVAQPRTLPDRRAQTQGVRQRARPRQGRPAPARAMLPTAGGAGGPRRRTVPLHRHQGQRPRHPPQRAP

SEQ ID NO: 837 - protein, 129 aa, Zea mays
MAPKVALFLALSLLFAATAHGCEPYCSGPVVPTPPVVPTPSSHSHGRCPIDALKLKVCANVLGLVKVGLPQYEQCCPLLEGLVDLDAALCLCTAIKANVLGIHLNVPLSLNLILNNCGKICPEDFTCPN

SEQ ID NO: 838 - protein, 129 aa, Zea mays; identical to SEQ ID NO: 837

SEQ ID NO: 839 - protein, 129 aa, Zea mays
MAPKVALFLALSLLFAAAAHGCEPYCPGPAVPTPPVLPTPSSHSHGRCPIDALKLKVCANVLGLVKVGLPQHEQCCPLLEGLVDLDAALCLCTAIKANVLGIHLNVPLSLNLILNNCGKICPEDFTCPN

SEQ ID NO: 840 - protein, 129 aa, Zea mays
MAPKVALFLALGLLFAAAAHGCEPYCPGPVVPTPTVVPTPSSHSHGRCPIDALKLKVCANVLGLVKVGLPQHEQCCPLLEGLVDLDAALCLCTAIKANVLDIHLNVPLSLNLILNNCGKICPKDFTCPN

SEQ ID NO: 841 - protein, 126 aa, Zea mays
MAPKVALFLALSLLFAAAAHGCGPYCSGPVVPTPPVVPSHSHGRCPIDALKLKVCANVLGLVKVGLPQHEQCCPLLEGLVDLDAALCLCTAIKANVLGIHLNVPLSLNLILNNCGKICPKDFTCPN

SEQ ID NO: 842 - protein, 121 aa, Zea mays
MAPKVALFLALSLLFAAAAHGCEPYCPDTVVPTSHSHGRCPIDTLKLKVCANVLGLVKVGLPQHEQCCPLLEGLVDLDAALCLCTAIKANVLGIDLNVPLSLNLILNNCGKICPKDFTCPN

SEQ ID NO: 843 - protein, 129 aa, Sorghum bicolor
MAPKAALFLALGLLLAASAHGCEPSCSGPVVPTPPVVPTPPTHSHGGRCPIDALKLSVCANVLGLVKVGLPPQQECCPLLEGLVDLDAALCLCTAIKANVLGIHLNVPVSLSLILNNCGKICPEDFTCY

SEQ ID NO: 844 - protein, 166 aa, Sorghum bicolor
MSARAAPPPSPPLARGTSTQCSTASCSHRRSSNNPSPMAPKAALFLALGLLLAASAHGCEPSCSGPVVPTPPVVPTPPTHSHGGRCPIDALKLSVCANVLGLVKVGLPPQQECCPLLEGLVDLDAALCLCTAIKANVLGIHLNVPVSLSLILNNCGKICPEDFTCY

SEQ ID NO: 845 - protein, 127 aa, Saccharum officinarum
MAPKVALFLALGLLLAAAAHGCEPYCSGPVVPTPPPPSHSHGRCPIDALKLSVCANVLDLVKVGLPPHQECCPLLMGLVDLDAALCLCTAIKANVLNIIDLSVNLGVKLILNNCGKFCPEDFTCPTY

SEQ ID NO: 846 - protein, 157 aa, Triticum sp.
  misc_feature (142)..(142): Xaa can be any naturally occurring amino acid
  misc_feature (151)..(151): Xaa can be any naturally occurring amino acid
MAPKVALFLALSLLFAAAAHGCEPYVPGPVVPTPPVVPSHSHGRCPIDALKLKVCANVLDLVKVGLPQHEQCCPLLEGLVDLDAALCLCTAIKANVLGINSTCPLASTSSSTIAARFVQRTYLPQLIELNMEIKHIKECTLXVHLRFDVLXTPLQLN

SEQ ID NO: 847 - protein, 116 aa, Zea mays
MDTSKSKQGPEHLLVLVHGIMASPKDWTYGEAVLKRRLGDDFFIYASSTNSYTKTFDGIDVAGRRLANEVRPLKFVLEKRFQTFSLLETDISCSWILMNCLEALIIVPMETGLGSG

SEQ ID NO: 848 - protein, 375 aa, Zea mays
MDTSKSKQGPEHLLVLVHGIMASPKDWTYGEAVLKRRLGDDFFIYASSTNSYTKTFDGIDVAGRRLANEVLEVVNKMPSLRKISFLAHSLGGLFARYAIAILHSVSVETKNAGQSSALTVPTTRGPAKSRCASGLGSIAGLQPINFITLATPHLGVRGRNQLPFLQGLSILEKLAAPLAPLIVGRTGAQLFLTDGDPSKPPLLLQMASDCDDKNYISALAAFKNRVLYANVSYDHMVGWRTSSLRREKNLIKPSHRSLDGYKHIVNVEYCSPVSSEGPHFPSKAARAKEAAQRTPNRENTEEYHQMMEEEMLHGLQKVGWKKVDVNFHSSFWPYSAHNNIHVKNEWLHNAGAGVIAHVADSIKQQESRPCLPANL

SEQ ID NO: 849 - protein, 377 aa, Zea mays
MDTSKSKQGPEHLLVLVHGIMASPKDWTYGEAVLKRRLGDDFFIYGKANSSFTRLITSFEVCPRKLWKQVLDVVNKMPSLRNISFLAHSLGGLFARYAIAILHSVSVETKNAGQSSALTVPTTRGPAKSRCASGLGSIAGLRPINFITLATPHLGVRGRNQVQLPFLQGLSILEKLAAPLAPLIVGRTGAQLFLTDGDPSKPPLLLQMASDCDDKNYISALAAFKNRVLYANVSYDHMVGWRTSSLRREKNLIKPSHRSLDGYKHIVNVEYCSPVSSEGPHFPSKAARAKEAAQRSPNRENTEEYHQMMEEEMLHGLQKVGWKKVDVNFHSSFWPYSAHNNIHVKNEWLHNAGAGVIAHVADSIKQQESRPCLPANL

SEQ ID NO: 850 - protein, 384 aa, Oryza sativa
MEKSQRKRGPDHLLILVHGIIASPSDWTYGEAVLKKRLGDNFFIYGSSSSNIYTKTFDGIDVAGRRVSGLMLLEEGLANEVLDVIQKMAGLRKISFLAHSLGGLFARYAISILYSTAMKDASQSAACIAPTTGGSEKLECTSGLGAIAGLEPINFITLATPHLGVRGKNQLPFLQGLSILEKIAAPLAPLVVGRTGAQFFLTDGEPSKPPLLLEMASDHEDKKFMSALAAFKNRILYANVSYDMVGWRTSSIRREKDLTMQPSHRSLDGYKHIVNMEYCSPISSDGPHFPLQAARAKEAAQSRPNKENTEEYHEMMEEEMIHGLQRVGWKKVDVNFHTALWPYFAHNNIHVKNEWLHNAGAGVIAHVADSIKQQESRKYFRANL

SEQ ID NO: 851 - protein, 161 aa, Zea mays; identical to SEQ ID NO: 136

SEQ ID NO: 852 - protein, 59 aa, Hordeum vulgare
MASSCSFLLLAALLALVSWQATSSDPSPLQDFCVADMHSPGTVRLLTMLSPNTYAEINF

SEQ ID NO: 853 - protein, 229 aa, Hordeum vulgare
MASSPTYLLLVALFALVSWQAVASDPGPLQDFCVADMHSPVRVNGFVCKNPMDANADDFFKAAALDKPRVTNKVGSNVTLINVMQIAGLNTLGISIARIDYAPLGQNPPHTHPRATEILTVLEGTLYVGFVTSNLPAPNRNKFLSKVLNKGDVFVFPVGLIHFQFNPNPHQPAVAIAALSSQNPGAITIANAVFGSDPTISDDVLAKAFQVEKNTIDWLQAQFWENNQN

SEQ ID NO: 854 - protein, 229 aa, Hordeum vulgare
MTTSSSILLLAALLALVSWQAIASDPDPLQDFCVADMHSPVRVNGFVCKNPMEVNADDFFKAANLDKPRVTNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHQPAVAIAALSSQNPGAITIANAVFGSDPPISDDVLSKAFQVEKNTIDYLQAQFWENNHN

SEQ ID NO: 855 - protein, 229 aa, Hordeum vulgare
MASSCSFLLLAALLALVSWQATSSDPSPLQDFCVADMHSPVRVNGFVCKNPMDVNADDFFKAAALDKPRVTNKVGSNVTLINVMQIAGLNTLGISIARIDYAPLGQNPPHTHPRATEILTVLEGTLYVGFVTSNLPAPNRNKFLSKVLNKGDVFVFPVGLIHFQFNPNPHQPAVAIAALSSQNPGAITIANAVFGSDPAISDDVLAKAFQVEKNTIDWLQAQFWENNHN

SEQ ID NO: 856 - protein, 198 aa, Hordeum vulgare
  misc_feature (31)..(31): Xaa can be any naturally occurring amino acid
MASALSSLRYGDSLSVVAISGATAVLCEAIXWLLIYRTATYNSLRASIERHSRKLDSMKSTSSASGAAPSSQPASSRAKKMDRVESSLKDASRELSLAKLKSGAVVAAVLFVVFGLLNSLFEGRAVAKLPFAPVPLVQRMSHRGLPGNDPTDCAMVFLYFLCSMSIRTNLQKLLGFTPPRAAAGAGGGLFAMPDPKVN

SEQ ID NO: 857 - protein, 226 aa, Zea mays
MASSLVLIAAALLALASSWQQAIAYDPSPLQDFCVADKNSPVRVNGFPCKDPMAVTPDDFFNAAMIIDKRRDTNNKVGSNVTNVNVESFPGLNTLGISLARIDYAPLGVNPPHIHPRATELLTVLEGTLYLGFVTSNPNRLFSKVVKKGDVFVFPKAMIHFQMNLDHDKPAAALSSLSSQNPGVITIASAVFGSKPPISDDVLAKAFQVEKKLIDWLQSQFWDTNY

SEQ ID NO: 858 - protein, 226 aa, Zea mays; identical to SEQ ID NO: 857

SEQ ID NO: 859 - protein, 226 aa, Zea mays
MVSSNFYLLSVLLIAIASGARATDPSPLQDFCVADKESTVRVNGLPCKDIKDVKVDDFFLAADLDKPRDTTTNKVKSNVTLINVMKLAGLNTLGISMARIDYAPQGQNPPHTHPRATEILTVLEGSLYVGFVTSNPDNKFFSKLLNKGDVFVFPQGLIHFQFNPSHDKPAVALAALSSQNPGAITISNAVFGSKPPIADDVLAKAFQVDKKVVDWLQAQFWEDNHN

SEQ ID NO: 860 - protein, 226 aa, Zea mays; identical to SEQ ID NO: 859

SEQ ID NO: 861 - protein, 226 aa, Zea mays
MASSSFYLLSVLLIVIASGAWATDPSPLQDFCVADKESPVLVNGFACKDVKDVKVDDFFLAADLDKPRDTTMSKVKSNVTLINVMKLAGLNTLGISMARIDYAPQGQNPPHTHPRATEILTVLEGSLYVGFVTSNPDNKFISKLLNKGDVFVFPQGLIHFQFNPSHDKPAVAIAALNSQNPGAITISNAVFGSKPPIADDVLAKAFQVDKKVVDWLQAQFWEDNHN

SEQ ID NO: 862 - protein, 204 aa, Zea mays
MAASTYFLLVAFLALVTSHAIASDPSPLQDFCVADKDSPVKVNGFVCKDPIAVNADDFFKAAKLDQPRDTTKSKVGSNVTLINVMQLPGLNTLGISLARIDYMPLGQNPPHTHPRATEILTVLEGTLYVGFVTSNQADRSNKLFAKVLNKGDVFVFPQGLIHFQFNPVPDKPAVALAALSSQNPGAITIANAVFGSKPPISMMY

SEQ ID NO: 863 - protein, 157 aa, Zea mays
MAASTYLLLVAFLALLTSQAIASDPSPLQDLCVADKHSPVNVNGFVCKDPMTVNADDFFKAAKLDQPRDTTKSKVGSNVTLINVMQLPGLNTLGISLARIDYAPLGQNPPHTHPRATEILTVLEGTLYVGFVTSNQADNTNKLFSKVLNKGDVFVFP

SEQ ID NO: 864 - protein, 228 aa, Zea mays
MAASTVLLVAFLALVTSHAIASDPSPLQDFCVADKDSPVKVNGFVCKDPMAVNADDFFKAAKLDQPRDTTKSKVGSNVTLINVMQLPGLNTLGISLARIDYAPLGQNPPHTHPRATEILTVLEGTLYVGFVTSNQADRSNKLFAKVLNKGDVFVFPQGLIHFQFNPVHDKPAVALAALSSQNPGAITIANAVFGSKPPISDDVLAKAFQVQKGTIDWLQAQFWENNHY

SEQ ID NO: 865 - protein, 229 aa, Zea mays
MAASTYLLLVAFLALLTSQAIASDPSPLQDLCVADKHSPVNVNGFVCKDPMTVNADDFFKAAKLDQPRDTTKSKVGSNVTLINVMQLPGLNTLGISLARIDYAPLGQNPPHTHPRATEILTVLEGTLYVGFVTSNQADNTNKLFSKVLNKGDVFVFPQGLIHFQFNPIHDKPAVAIAALSSQNPGVITIANAVFGSKPPISDDVLAKAFQVQKGTIDWLQAQFWENNHY

SEQ ID NO: 866 - protein, 228 aa, Zea mays
  misc_feature (5)..(5): Xaa can be any naturally occurring amino acid
  misc_feature (10)..(10): Xaa can be any naturally occurring amino acid
MAALXYFLLXAFLALVTSQAIASDPSPLQDFCVADKYSPVKVNGFVCKDPMAVNADDFFKAAKLDQPRDTKNKVGSNVTLINVMQLPGLNTLGISLARIDYAPLGQNPPHTHPRATEILTVLEGKLYVGFVTSNQANSNNKLFTKVLNKGDVFVFPQGLIHFQFNPVHDKPAVAIAALSSQNPGVITIANAVFGSKPPISDDVLAKAFQVQKGTIDWLQAQFWENNHY

SEQ ID NO: 867 - protein, 229 aa, Zea mays
MAASTYFLLVAFLALVTSHAIASDPSPLQDFCVADKDSPVKVNGFVCKDPIAVNADDFFKAAKLDQPRDTTKSKVGSNVTLINVMQLPGLNTLGISLARIDYMPLGQNPPHTHPRATEILTVLEGTLYVGFVTSNQADRSNKLFAKVLNKGDVFVFPQGLIHFQFNPAHDKPAVALAALSSQNPGAITIANAVFGSKPPISDDVLAKAFQVQKGTIDWLQAQFWENNHY

SEQ ID NO: 868 - protein, 228 aa, Zea mays
MAALTYFLLVAFLALVTSQAIASDPSPLQDFCVADKYSPVKVNGFVCKDPMAVNADDFFKAAKLDQPRDTKNKVGSNVTLINVMQLPGLNTLGISLARIDYAPLGQNPPHTHPRATEILTVLEGKLYVGFVTSNQANSNNKLFTKVLNKGDVFVFPQGLIHFQFNPVHDKPAVAIAALSSQNPGVITIANAVFGSKPPISDDVLAKAFQVQKGTIDWLQAQFWENNHY

SEQ ID NO: 869 - protein, 228 aa, Zea mays
MAASTYFLLVAFLALVTSQAIASDPSPLQDFCVADKYSPVKVNGFVCKDPMAVNADDFFKAAKLDQPRDTKSKVGSNVTLINVMQLPGLNTLGISLARIDYAPLGQNPPHTHPRATEILTVLEGTLYVGFVTSNQADNTNKLFSKVLNKGDVFVFPQGLIHFQFNPIHDKPAVAIAALSSQNPGVITIANAVFGSKPPISDDVLAKAFQVQKGTIDWLQAQFWENNHY

SEQ ID NO: 870 - protein, 225 aa, Zea mays
MAASSYFLLAAFLAVTASHATASDPSPLQDFCVADIHSPVKVNGFVCKDPMAVTPDDFFKAANLDKARDTMKSKVGSNVTLINVIQLPGLNTLGISLARIDYAPLGENPPHTHPRATEILTVLEGTLYVGFVTSNPNKLFAKVLNKGDVFVFPQGLIHFQFNPVYDKPAVAIAALSSQNPGVITIANAVFGSKPPISDDVLAKAFQVEKGTIDWLQAQFWENNHY

SEQ ID NO: 871 - protein, 225 aa, Zea mays
  misc_feature (166)..(166): Xaa can be any naturally occurring amino acid
MAASSYFLLAAFLAVTASHATASDPSPLQDFCVADIHSPVKVNGFVCKDPMAVTPDDFFKAANLDKARDTMKSKVGSNVTLINVIQLPGLNTLGISLARIDYAPLGENPPHTHPRATEILTVLEGTLYVGFVTSNPNKLFAKVLNKGDVFVFPQGLIHFQFNPVYXKPAVAIAALSSQNPGVITIANAVFGSKPPISDDVLAKAFQVEKGTIDWLQAQFWENNHY

SEQ ID NO: 872 - protein, 224 aa, Oryza sativa
MASSSLFLLGALLVLASWQAIVAYDPSPLQDFCVADMNSPVRVNGFACKNPMDVSSEDFFNAAKFDMPRNTFNKLGSNVTNLNVMEFPGLNTLGISLARIDYAPMGVNPPHIHPRATELLTVLEGTLYVGFVTSNPNKLFSKVVCKGDVFVFPKAMIHFQMNLDHDKPAVAQSALSSQNPGVITIASAVFGSQPPISDDVLTKAFQVEKKLIDWLQSQFWENNY

SEQ ID NO: 873 - protein, 224 aa, Oryza sativa; identical to SEQ ID NO: 872

SEQ ID NO: 874 - protein, 225 aa, Oryza sativa
MASSSLFLLASLLVLASWQQAIAFDPSPLQDFCVADMASPVRVNGFPCKNPMNVTSDDFFNAAKFDMPRNTMNKVGSNVTNLNVINFPGLNTLGISLARIDYAPMGVNPPHVHPRATELLTVLEGTLYVGFVTSNPNRLFSKVVHKGDVFVFPKAMIHFQMNLDHNKPAVAQSALSSQNPGVITIASAIFGSTPPISDDVLVKAFQVEKKVIDWLKSQFSENNHY

SEQ ID NO: 875 - protein, 225 aa, Oryza sativa; identical to SEQ ID NO: 874

SEQ ID NO: 876 - protein, 221 aa, Oryza sativa
MASSSFSFLLVAALLGLASWKAIASDPSPLQDFCVADLNSPVRVNGFVCKNPMNASADDFFKAAMLDKPRDTNNKVGSNVTLVNVLQLPGLNTLGISIARLDFAPLGLNPPHTHPRATEIFTVLEGTLYVGFVTSNPDNRLLSKVLNKGDVFVFPEGLIHFQFNPNPHKPAVAIAALSSQNPGVITIANAVFGSNPPISDDILMKAFQVDKKIIDLLQAQF

SEQ ID NO: 877 - protein, 221 aa, Oryza sativa; identical to SEQ ID NO: 876

SEQ ID NO: 878 - protein, 229 aa, Oryza sativa
MASSNFFLPTALIALVATQAMAFDPSPLQDFCVADRNSPVRVNGFPCKDAKDVNVDDFFLEANLDKPMDTTKSKAGSNVTLINVMKLTGLNTLGISMARIDYAPKGQNPPHTHPRATEILTVFEGTLYVGFVTSNQANGENKLFTKTLNKGDVFVFPQGLIHFQFNPSYDKPAVAIAALSSQNPGAITIANAVFGSNPPISDDVLAKAFQVDKKAVDWLQAQFWENNHN

SEQ ID NO: 879 - protein, 229 aa, Oryza sativa; identical to SEQ ID NO: 878

SEQ ID NO: 880 - protein, 229 aa, Oryza sativa
MASSNFFLLTALIALVATQAMASDPSPLQDFCVADRNSPVHVNGFPCKDAKDVNVDDFFLAANLDKPMDTTKSKAGSNVTLINVMKLAGLNTLGISMARIDYAPKGQNPPHTHPRATEILTVLEGTLYVGFVTSNQANGENKLFTKTLNKGDVFVFPQGLIHFQFNPSYDKPAVAIAALSSQNPGAITIANAVFGSNSPISDDVLAKAFQVDKKAVDWLQAQFWENNHN

SEQ ID NO: 881 - protein, 225 aa, Oryza sativa
MASPSSFCLLAVLLALVSWQAIASDPSPLQDFCVADKHSPVLVNGFACLDPKYVNADHFFKAAMLDTPRKTNKVGSNVTLINVMQIPGLNTLGISIARIDYAPLGENPPHTHPRATEILTVLEGTLYVGFVTSNPNNTLFSKVLNKGDVFVFPEGLIHFQFNPNPHQPAVALAALSSQNPGAITIANAVFGSKPPISDDILAKAFQVEKGTIDWLQAQFWENNHY

SEQ ID NO: 882 - protein, 225 aa, Oryza sativa; identical to SEQ ID NO: 881

SEQ ID NO: 883 - protein, 224 aa, Oryza sativa
MASPSSLCLLAALALISWQAMASDPSPLQDFCVADMHSPVRVNGFACLNPMEVNADHFFKAAKLDTPRKTNKVGSNVTLINVMQIPGLNTLGISIARIDYAPLGQNPPHTHPRATEILTVLEGTLYVGFVTSNPNNTLFSKVLNKGDVFVFPQGLIHFQFNPNPHQPAVAIAALSSQNPGAITIANAVFGSKPPISDEVLAKAFQVEKGTIDWLQAQFWENNHY

SEQ ID NO: 884 - protein, 224 aa, Oryza sativa
MASPSFCLFAALLALVSWQAIASDPSPLQDFCVADKHSPVLVNGFACLDPKYVTADHFFKAAMLDTPRKTNKVGSNVTLINVMQIPGLNTLGISIARIDYAPLGQNPPHTHPRATEILTVLEGTLHVGFVTSNPNNTLFSKVLNKGDVFVFPVGLIHFQFNPNPHQPAVAIAALSSQNPGVITIANAVFGSKPPISDEVLAKAFQVGKGTIDWLQAQFWENNHY

SEQ ID NO: 885 - protein, 224 aa, Oryza sativa; identical to SEQ ID NO: 883

SEQ ID NO: 886 - protein, 224 aa, Oryza sativa; identical to SEQ ID NO: 884

SEQ ID NO: 887 - protein, 224 aa, Oryza sativa
MASSSFLLLATLLAMASWQGMASDPSPLQDFCVADMHSPVLVNGFACLNPKDVNADHFFKAAMLDTPRKTNKVGSNVTLINVMQIPGLNTLGISIARIDYAPLGQNPPHTHPRATEILTVLEGTLYVGFVTSNPDNKFFSKVLNKGDVFVFPVGLIHFQFNPNPYKPAVAIAALSSQNPGAITIANAVFGSKPPISDDVLAKAFQVEKGTIDWLQAQFWENNHY

SEQ ID NO: 888 - protein, 224 aa, Oryza sativa; identical to SEQ ID NO: 887

SEQ ID NO: 889 - protein, 224 aa, Oryza sativa
MASPSICLLAALLALVSWQAIASDPSPLQDFCVADMHSPVLVNGFACLDPKYVNADHFFKAAMLDTPRKTNKVGSNVTLINVMQIPGLNTLGISIARIDYAPLGENPPHTHPRATEILTVLEGTLYVGFVTSNPNNTLFSKVLNKGDVFVFPEGLIHFQFNPNPHQPAVAIAALSSQNPGAITIANAVFGSKPPISDIVLAKAFQVEKGTIDWLQAQFWENNHY

SEQ ID NO: 890 - protein, 224 aa, Oryza sativa; identical to SEQ ID NO: 889

SEQ ID NO: 891 - protein, 224 aa, Oryza sativa
MASPSFCLLAALLALVSWQAIASDPSPLQDFCVADKHSPVLVNGFACLDPKYVTADHFFKAAMLDTPRKTNKVGSNVTLINVMQIPGLNTLGISIARIDYAPLGENPPHTHPRATEILTVLEGTLYVGFVTSNPNNTLFSKVLNKGDVFVFPEGLIHFQFNPNPHQPAVAIAALSSQNPGAITIANAVFGSKPPISDKVLAKAFQVEKGTIDWLQAQFWENNHY

SEQ ID NO: 892 - protein, 224 aa, Oryza sativa; identical to SEQ ID NO: 891

SEQ ID NO: 893 - protein, 229 aa, Sorghum bicolor
MASSSSSLLLLAAALLALVASWQQAIAYDPSPLQDFCVADKNSPVRVNGFPCKDPMAVTPDDFFNPAMIIDKRRDTNNKVGSNVTNINVESFPGLNTLGISLARIDYAPLGVNPPHIHPRATELLTVLEGTLYLGFVTSNPNRLFSKVVKKGDVFVFPKAMIHFQMNLDHEKPATALSSLSSQNPGVITIASAVFGSKPPISDDVLAKAFQVEKKLIDWLQSQFWDTNY

SEQ ID NO: 894 - protein, 229 aa, Sorghum bicolor; identical to SEQ ID NO: 893

SEQ ID NO: 895 - protein, 227 aa, Sorghum bicolor
  misc_feature (111)..(112): Xaa can be any naturally occurring amino acid
MASSNFYLLSVLLIMIASGARAMDPSPLQDFCVADKDSPVRVNGLPCKDVKDVKVDDFFLAANLDKPRDTTMSKVKSNVTLINVMKLAGLNTLGISMARIDYAPQGQNPPXXTHPRATEILTVLEGSLYVGFVTSNPDNKFFSKLLNKGDVFVFPQGLIHFQFNPSHDKPAVAIAALSSQNPGAITISNAVFGSKPSIADDVLAKAFQVDKKVVDWLQAQFWEDNHN

SEQ ID NO: 896 - protein, 226 aa, Sorghum bicolor
MASSNFYLLSVLLIMIASGARAMDPSPLQDFCVADKDSPVRVNGLPCKDVKDVKVDDFFLAANLDKPRDTTMSKVKSNVTLINVMKLAGLNTLGISMARIDYAPQGQNPPHTHPRATEILTVLEGSLYVGFVTSNPDNKFFSKLLNKGDVFVFPQGLIHFQFNPSHDKPAVAIAALSSQNPGAITISNAVFGSKPSIADDVLAKAFQVDKKVVDWLQAQFWEDNHN

SEQ ID NO: 897 - protein, 228 aa, Sorghum bicolor
MAPATYFLLVSFLALVTSQAIASDPSPLQDFCVADIHSPVKVNGFVCKDPMAVNADDFFKAANLDKPRDTMKSKVGSNVTLINVMQLPGLNTLGISLARIDYAPLGQNPPHTHPRATEILTVLEGTLYVGFVTSNTDNGNKLFTKVLKKGDVFVFPQGLIHFQFNPKHDKPAVAIAALSSQNPGAITIANAVFGSKPPISDDVLAKAFQVQKGTIDWLQAQFWENNHN

SEQ ID NO: 898 - protein, 228 aa, Sorghum bicolor
MAASSYFILVSFVAFVISQATASDPSPLQDFCVADKHSPVKVNGFVCKDPMAVNADDFFKAAKLDQPRDTMKSKVGSNVTLINVMQLPGLNTLGISMARIDYAPLGQNPPHTHPRATEILTVLEGTLYVGFVTSNTDNGNKLFTKVLNKGDVFVFPQGLIHFQFNPVHDKPAVAIAALSSQNPGAITIANAVFGSKPPISDDVLAKAFQVQKGTIDWLQAQFWENNHN

SEQ ID NO: 899 - protein, 228 aa, Sorghum bicolor; identical to SEQ ID NO: 898

SEQ ID NO: 900 - protein, 228 aa, Sorghum bicolor
MAPTTYFLLVSFLALVTSQAIASDPSPLQDFCVADIHSPVKVNGFVCKDPMAVNVDDFFKAANLDKPRDTMKSKVGSNVTLINVMQLPGLNTLGISLARIDYAPLGQNPLHTHPRATEILTVLEGTLYVGFVTSNTDNGNKLFTKVLNKGDVFVFPQGLIHFQFNPVHDKPAVAIAALSSQNPGAITIANAVFGSKPPISDDVLAKAFQVQKGTIDWLQAQFWENNHN

SEQ ID NO: 901 - protein, 228 aa, Sorghum bicolor; identical to SEQ ID NO: 900

SEQ ID NO: 902 - protein, 228 aa, Sorghum bicolor
MAPATYFLLVSLLAVVASQAIASDPSPLQDFCVADIHSPVKVNGFVCKDPMAVNADDFFKAANLDKPRDTMKSKVGSNVTLINVMQLPGLNTLGISLARIDYAPLGQNPPHTHPRATEILTVLEGTLYVGFVTSNTDNGNKLFAKVLNKGDVFVFPQGLIHFQFNPIHDKPAVAIAALSSQNPGAITIANAVFGSKPPISDDVLAKAFQVQKGTVDWLQAQFWENNHN

SEQ ID NO: 903 - protein, 229 aa, Triticum sp.
MASSSSFLLLAVLLALVSWQATASDPSPLQDFCVADMNSPVRVNGFVCKNPMEVNADDFFKAAALDKPRVTNKVGSNVTLINVMQIAGLNTLGISIARIDYAPLGQNPPHTHPRATEILTVLEGTLYVGFVTSNKPAPNRNKFLSKVLNKGDAFVFPVGLIHFQFNPNPHKPAVAIAALSSQNPGAITIANAVFGSDPQISDDVLAKAFQVEKNTIDWLQAQFWENNHN

SEQ ID NO: 904 - protein, 229 aa, Triticum sp.
MASSSSFLLLAALLALVSWQATASDPSPLQDFCVADMNSPVRVNGFVCKNPMEVNADDFFKAANLDKPRVPNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHQPAVAIAALSSQNPGAITIANAVFGSDPAISDDVLAKAFQVEKNTIDYLQAQFWENNHY

SEQ ID NO: 905 - protein, 229 aa, Triticum sp.
MATSSSILLLAALLALVSWQAIASDPGPLQDFCVADMHSPVRVNGFVCKNPMEVNADDFFKAANLDKPRVTNKVGSNVTLINVMQIAGLNTLGISIARIDYAPLGQNPPHTHPRATEILTVLEGTLYVGFVTSNQPAPNRNKLLSKVLNKGDVFVFPVGLIHFQFNPNPHQPAVAIAALSSQNPGAITIANAVFGSDPPISDDVLAKAFQVEKNTIDYLQAQFWENNHN

SEQ ID NO: 906 - protein, 229 aa, Triticum sp.
MASSPSFLLLAALLALVSWQAVASDPGPLQDFCVADMHSPVRVNGFVCKNPMEVNADDFFKAAALDKPRVTNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHKPAVGIAALSSQNPGAITIANAVFGSDPQISDDVLAKAFQVEKNTIDWLQAQFWENNHN

SEQ ID NO: 907 - protein, 229 aa, Triticum sp.
MASSPSFLLLAALLALVSWQAVASDPGPLQDFCVADMQSPVRVNGFVCKNPMEVNADDFFKAAALDKPRVTNKVGSNVTLINVMQIAGLNTLGISIARIDYAPLGQNPPHTHPRATEILTVLEGTLYVGFVTSNLPAPARNKFFSKVLNKGDVFVFPVGLIHFQFNPNPHQPAVAIAALSSQNPGAITIANAVFGSDPPISDDVLAKAFQVEKNTIDWLQAQFWENNHN

SEQ ID NO: 908 - protein, 229 aa, Triticum sp.
MASSSSFLLLAALLALVSWQATASDPSPLQDFCVADMNSPVRVNGFVCKNPMEVNADDFFKAANLDKPRMPNKVGSNVTLINVMQIAGLNTLGISIARIDYAPLGQNPPHTHPRATEILTVLEGTLYVGFVTSNQPAPNKNKFLSKVLNKGDVFVFPVGLIHFQFNPNPHQPAVAIAALSSQNPGAITIANAVFGSDPPISDDVLAKAFQVEKNTIDYLQAQFWENNHY

SEQ ID NO: 909 - protein, 229 aa, Triticum sp.
MASSPSFLLLAALLALVSWQAVASDPGPLQDFCVADMQSPVRVNGFVCKNPMEVNADDFFKAAALDKPRVTNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHQPAVAIAALSSQNPGAITIANAVFGSDPPISDDVLAKAFQVEKNTIDYLQAQFWENNHY

SEQ ID NO: 910 - protein, 262 aa, Triticum sp.
QKVEIQTLTYTTITNRNTREREREREREREKTNQMASSSYFLLLAALVALVSWQATASDPSPLQDFCVADMNSPVRVNGFVCKNPMEVNADDFFKAANLDKPRVTNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHKPAVAIAALSSQNPGAITIANAVFGSDPQISDDVLAKAFQVEKNTIDWLQAQFWENNH

SEQ ID NO: 911 - protein, 343 aa, Zea mays
MPSTDHGVPSTYPPLGYLHHSSAQLERTKRTHLGPLLLCFCFPTESPQPQALALCPLPSSPPMPPPPPLLEPRDYLGAGATSSCCSSCCSSGREGAGPHLALRLGLPGSDDSPGRGADTEHARAHVDAALTLGPGPGPAPPRGSAKRGFADSLDRSAKLDGVAADDAAGGVTRVAGAAAGAPPAAKAQVVGWPPVRSYRKNTLAASATKTNGGDEGRSEAGCCYVKVSMDGAPYLRKVDLKTYSSYEDLSLGLEKMFSCFITGQNSSCKTSRRDRLTDGSRVDALQDQEYVLTYEDKDADWMLVGDLPWDLFTTFCRKLRIMRGSDAAGMAPPRPPEQTVRNK

SEQ ID NO: 912 - protein, 279 aa, Sorghum bicolor
  misc_feature (110)..(110): Xaa can be any naturally occurring amino acid
MPPPLEARDFLGAGATSSCCSSSCSSGGDGTVPHLALRLGLPGSDSPGRGAQAEHAHVDAALTLGPAPAPAPPRGGAKRGFADSLDRSAKRDGAAADDDAAGGVTGEDKXVAAAAAGAPPAAKAQVVGWPPVRSYRKNTLAASATKTKVEDEGRSEAGCCYVKVSMDGAPYLRKVDLKTYSSYENLSLGLEKMFSCFITGQNSSCKTSRRDRFTDGSRADALQDQEYVLTYEDKDADWMLVGDLPWDLFTTICRKLRIMRGSDAAGMAPRSLEQIARNK

SEQ ID NO: 913 - protein, 212 aa, Zea mays
MAAIMAAGLVVLALLAAVAAPAHATDYVVGDSAGWASGVDYATWASGKTFAAGDNLVFQYSAMHTVAEVSSADYSACSASNSIQSYSDQNTKVALTAPGTRYFICGAPGHCGNGMKLTVTVAAAAATTTPETSTSTPAATTTPTTTNADTPNADTPPETSTSTPAATTPPTTTKSTSTSSTSSTGAACGGEARLGMGILAAAAGLAGLALMG

SEQ ID NO: 914 - protein, 195 aa, Zea mays; identical to SEQ ID NO: 146

SEQ ID NO: 915 - protein, 200 aa, Sorghum bicolor
MAAAIMAGLLILLAAVAAPAHAKDYTVGDSSGWTSGVDYTTWASGKTFAVGDNLVFQYSMMHTVAEVSSADFNACSASNAIQSYSDQNTKIALTAPGTRYFICGTAGHCGNGMKLAVTVPAAAATTPPASSSPPTTPAAPGADTPPETTTPSTSTPTATSPPTATKPTSSSAAAACGGEARLAMGMLAGAAGLAGLALMG

SEQ ID NO: 916 - protein, 261 aa, Hordeum vulgare; identical to SEQ ID NO: 152

SEQ ID NO: 917 - protein, 261 aa, Hordeum vulgare; identical to SEQ ID NO: 152

SEQ ID NO: 918 - protein, 252 aa, Zea mays
MLDMQKRRVRLLLFITGILALSMTAEKSRELVGKEAASKSGQSTFMNCFDKGSGSLACTSKEGVKLYVNNIRSAHLEMVRQRPMGKALADAVAEGLTPSEAAKQAQKVSAKATKIAARQANRILGPIISCGWDFFEAMYSGGSMMEGFLRGTGTLFGTYVGGFHGEERFGKLGYLAGSHVGSWGGGRIGLMIYDVISGLKYMFMSVQPKYESSSYASEDGPEYAKRYTNQEEPTYYEPSKEKQEESKWFGLF

SEQ ID NO: 919 - protein, 251 aa, Zea mays; identical to SEQ ID NO: 151

SEQ ID NO: 920 - protein, 251 aa, Zea mays; identical to SEQ ID NO: 151

SEQ ID NO: 921 - protein, 254 aa, Oryza sativa
MLDIQKRRVQLLLFIVGVLALSMTAEKFRELVGKEEASKSGQFTFMNCFDMGSGSLACAVKEGIKLYVYNLQTAHTERVRHRAIEKALADAVTEGLSAAEAAKQAQKVGAKAAKVAARQAKRILGPIISSGWDFFEAMYFGGSMTEGFLRGTGTLFGTYVGGFHGEERLGRFGYLTGSHLGSWVGGRIGLMIYDVINGLKYMLQFVKPEYEASAYYSKESTEYAYSYRSGEREEPTYYETSEENQEESQGFSLF

SEQ ID NO: 922 - protein, 252 aa, Sorghum bicolor
MLDIQKRRVRLLLLITGVVALSMTAEKFRELVGKEAASKSGQFTFMNCFDMGSGSLACTAKEGVKLYVNNIRSAHLEMVRQRAMEKALADAVTQGLTPGEAAKQAQKVSAKATKVAARQANRILGPIISCGWDFFEAMYFGGSMTEGFLRGTGTLFGTYVGGFHGEERFGKLGYLAGSQIGSWGGGRIGLMIYDIISGLKYMFLSIQPEYESSSYASEYGSEYTEIYTNREESTYYETSEEKQEESKWFGLF

SEQ ID NO: 923 - protein, 258 aa, Triticum sp.
  misc_feature (92)..(92): Xaa can be any naturally occurring amino acid
  misc_feature (130)..(130): Xaa can be any naturally occurring amino acid
  misc_feature (152)..(152): Xaa can be any naturally occurring amino acid
MLDIQKRRVQLLLFVAGVLALSMTAEKCRELVGKEAASKSGQFTFMNCFDMGSGSLACAGKEGVKLYVNNLRSAHMENVRQRAIEKALADAXTEGLSPAEAAKQAQKIGAKATKVAARQAKRILGPIISXGWDFFEAMYFGGSMTKDFLRGXGTLFGTYAGGFHGEERLGKLGYLVGSQLGSWVGGRIGLMVYDVINGLNYMLEFVRPEEYRSSSYYDSEEGSEYADNYRSGEGDEPTFSETLEEAQQEEESGGFSLF

SEQ ID NO: 924 - protein, 274 aa, Triticum sp.
MLDIQKRRVQLLLFVAGVLALSMTAEKCRELVGKEAASKSGQFTFMNCFDMGSGSLACAGKEGVKLYVNNLRSAHIETVRQRALEKALADALTEGLSPAEAAKQAQKIGAKATKVAARQAKRILGPIISCGWDFFEAMYFGGSMTEGFLRGMGTLFGTYAGGFHGEERLGKLGYLVGSQLGSWVGGRIGLMVYDVINGLNYMLEFVRPEEYRSSSYAAEEGSEYADNYRSSSYVSEEGSEYADNYRSREGYEPTYSETPEEAQAEEDSGGFSLF

SEQ ID NO: 925 - protein, 591 aa, Zea mays
MGTRPRGVVLAPWAVVLVLVLVLALRLAGASHVIHRSLEAEVPPSVPASIVSPLLRTGYHFQPPMNWINDPNAPLYYKGWYHLFYQYNPKGAVWGNIVWAHSVSRDLINWVALEAAIYPSIPSDKYGCWSGSATILEDGTPAILYTGIDRPDINYQVQVLALPKDASDPLLREWEKPEEYNPVATPAAGINATQFRDPTTAWRHAGAGHWRMLVGSVRGARGMALVYRSRDFRTWTKAKHPLHSAALTGMWECPDFFPVSGPGLQAGLDTSAPGTKYVLKSSLDLTRYDYYTIGSYDGGKDRYYPDDPAGDYRRRLRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELEAGTSLLEKAEAFDPAYDDDAQKLCGVKGADARGGVGPFGLWVLASADLQERTAVFFRVFRDGHGKPKVLMCTDPTKSSLSPDLYKPTLAGLVDADISSGKITLRSLIDRSVVESFGAGGKTCILSRVYPSIAVGKDAHLYVFNNGEVDVTVSGLTAWEMKKPLMNGA

SEQ ID NO: 926 - protein, 417 aa, Zea mays
MGTRPRGVVLAPWAVVLVLALRLAGASHVIHRSLEAEAPPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRPDINYQVQVLALPKDASDPLLREWEKPEEYNPVATPAAGINATQFRDPTTAWRHAGHWRMLVGSVRGARGMALVYRSRDFRTWTKAKHPLHSAALTGMWECPDFFPVSGPGMQAGLDTSAPGRKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQVSFYTLATF

SEQ ID NO: 927 - protein, 590 aa, Zea mays
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGTKYVLKSSLDLTRYDYYTIGSYDGGKDRYYPDDPAGDYHHRRRYDYGNYYASKTFYDPVERRRVLLGWANESDSVTDDKAKGWAGIHAIPRKIWLDPTGKQLLQWPIHEVEKPRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 928 - protein, 465 aa, Zea mays
MEITYSNSQPASRLERAVFPYKTAPTRPVPGRANPIQTVPCPSLPRNAAMGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGRKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQVSFIL

SEQ ID NO: 929 - protein, 639 aa, Zea mays
MEITYSNSQPASRLERAVFPYKTAPTRPVPGRANPIQTVPCPSLPRNAAMGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLINWVALEPAIYPSIPSDKYGCWSGSATILEDGTPAILYTGIDRADINYQVQVLALPKDASDPLLREWEKPEEYNPVATPAAGGINATQFRDPTTAWRHAGHWRMLVGSVRGARGMALVYRSRDFRKWTKAKHPLHSAALTGMWECPDFFPVSGPGLQAGLDTSAPGRKYVLKSSLDLTRYDYYTIGSYDGGKDRYYPDDPAGDYHHRRRYDYGNYYASKTFYDPVERRRVLLGWANESDSVPDDKAKGWAGIHAIPRKIWLDPTGKQLLQWPIHEVEKLRGKAVSVDAKLVKPGDHFEVTGIATYQADVEVSFELELEAGTSLLEKAEAFDPAYDDDAQKLCGVKGADARGGVGPFGLWVLASADLQERTAVFFRVFRDGHGKPKVLMCTDPTKSSLSPDLYKPTFAGFVDADISSGKITLRSLIDRSVVESFGAGGKTCILSRVYPSIAVGKDAHLYVFNNGEVDVTVSGLTAWEMKKPLMNGA

SEQ ID NO: 930 - protein, 637 aa, Oryza sativa
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARLGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHVNYSYNFAILISCTTYLHKCLMLLVILIQELTKRKRKIGGTRGLIRIDLEIDGLACVVGRRSQERYGLDPSGKQLLQWPIEELETLRGKSVSVFDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 931 - protein, 577 aa, Oryza sativa
MGTRLLALAPWLLLLLLQLAGASHVVHRSLEAEQAPSSVPASIVSPLLRTGYHFQPPMNWINDPNGPLYYKGWYHLFYQYNPKGAVWGNIVWAHSVSQDLINWIALEPAIKPDIPSDQYGCWSGSATILPDGTPAILYTGIDRPNINYQVQNIAFPKNASDPLLREWVKPAYNPVATPEPGMNATQFRDPTTAWYADGHWRMLVGGLKGARLGLAYLYRSRDFKTWVRAKHPLHSALTGMWECPDFFPLQAPGLQAGLDTSVPSSKYVLKNSLDLTRYDYYTVGIYNKVTERYVPDNPAGDYHRLRYDYGNFYASKTFFDPVKHRRILLGWANESDSVTYDKAKGWAGIHAIPRKVWLDPSGKQLLQWPIEELETLRGKSVSVFDKVVKPGEHFQVTGLGTYQADVEVSLEVSGLEKAEALDPAFGDDAERLCGAKGADVRGGVVFGLWVLASAGLEEKTAVFFRVFKPAGHGAKPVVLMCTDPTKSSLSPDLYKPTFAGFVDTDISSGKISLRSLIDRSVVESFGAGGKTCILSRVYPSMAIGDKAHLYVFNNGEADIKISHLKAWEMKKPLMNGA

SEQ ID NO: 932 - protein, 524 aa, Sorghum bicolor
  misc_feature (261)..(261): Xaa can be any naturally occurring amino acid
  misc_feature (275)..(275): Xaa can be any naturally occurring amino acid
MGTRQRVLAPWAVLLLTALQLAGASHVVVHRSLEAEAAAAPPSVPASIVSPLLRTGYHFQPPMNWINDPNAPMYYKGWYHLFYQYNPKGAVWGNIVWAHSISRDLINWIALEPAIYPSIPSDQYGCWSGSATMLQDGTPAILYTGINRPDINYQVQVLAFPKNASDPLLREWEKPAAYNPVAAPVGGINATQFRDPTTAWYADGHWRMLVGSVRDTRGMAIVYRSRDFRRWTKAKHPLHSALTGMWECPDFFPVSGPALQXGVDTSDAGAKYVLXNSLDLTRYDYYTIGSYDKRKDRYYPDNPNGDYHRLRYDYGNFYASKTFYDPAKRRRVLLGWANESDSVPDDKAKGWAGIHAIPRKIWLDPSGKQLLQWPIEEVEKLRGKAVTVGGKVVKPGEHFEVTGIATYQADVEVSFEISSLDKAEPFDPAYDNDAQKLCGVKGADVKGGVGPFGLWVLASADLQEKTAVFFRVFKDGYGKPKVLMCTDPTKSSLSPDLYKPTFAGFVDTDISSGKIALRSLVRTD

SEQ ID NO: 933 - protein, 578 aa, Saccharum officinarum
MGTRQRVLAPWAVLLLALQVAGASHVIHRSLEAEAAPPSVPASIVSPLLRTGYHFQPPMNWINDPNAPMYYKGWYHLFYQYNPKGAVWGNIVWAHSVSRDLINWIALDPAIYPSIPSDQYGCWSGSATMLKDGTPAILYTGINRPDINYQVQVLAFPKNASDPLLREWEKPAAYNPVAAPVGGINATQFRDPTTAWYADGHWRMLVGSVRDTRGMALVYRSRDFRTWRKAKHPLHFALTGMCGVPGLLSGVRAGARGRARHLRRRGPKYVLKSSLDLTRYDYYTIGSYQRRKDRYYPDNPNGDYHRLRYNYGNFYASKTFYDPANRRRVLLGWANKSDSVPDDKAKGWAGIHAIPRKIWLDPSGKQLLQWPIEEVEKLRGKPVSVGSKLVKPGEHFEVTGVATYQADVEVTFEVSSLEKAEAFDPAYGNDAQKLCGVKGADVKGGVGPFGLWVLASADLQEKTAVFFRVFKDGYGKPKVLMCTDPTKSSLSPDLYKPTFAGFVDTDISSGKIALRSLIDRSVVESFGAGGKTCILSRVYPSIAVGKDAHLYVFNNGEVDVKVSSLTAWEMKKPLMNGA

SEQ ID NO: 934 - protein, 588 aa, Zea mays
  misc_feature (171)..(172): Xaa can be any naturally occurring amino acid
  misc_feature (299)..(300): Xaa can be any naturally occurring amino acid
MGMAALLLVWALLHCAGTVTMVRASHAVYPELQSLEAEKVDETSRTGYHFQPPKHWINDPNGPMYYKGLYHLFYQYNPKGAVWGNIVWAHSVSTDLIDWTALAPGIYPSRQFDVKGCWSGSATVLPSGVPVVMYTGIDPDEHQVQNVAYPKNLSDPFLREWVKPDYNPIIXXDSGVNASAFRDPTTAWYGPDRHWRLLVGSKVGGKGLAVLYRSRDFRRWVKAHHPLHSGLTGMWECPDFFPVAVHGGGRHYRRGVDTAELHDRALAEEVKYVLKVSLDLTRYEYYTVGTYDHATDRYXXDAGFRDNDYGLRYDYGDFYASKSFYDPAKRRRVLWGWANESDTVPDDRRKGWAGIQAIPRKLWLSPRVRQLIQWPVEEVKALRAKHVNVSDKVVKSGQYFEVTGFKSVQSDVEVEFAIGDLSKAERFNPRWLTDPQALCKKRGARETGEVGPFGLWVLAAGDLTERTAVFFRVFRANSSSSSRLVVLMCNDPTNSTFEAQVYRPTFASFVNVDIARTKTIALRTLIEPSVVESFGAGGRTCILTRVYPKKALGDNAHLFVFNHGEVDVKVTRLDAWEMRTPKMNVPAQ

SEQ ID NO: 935 - protein, 586 aa, Oryza sativa
MATARARAALVFVALLQMAAVVVVRASHVVYPELQSLEAKHVDGKLRTGYHFQPPKHWINDPNGPMYYKGLYHLFYQYNPKGAVWGNIEWAHSVSTDLIDWTALEPGIYPSKTFDEKGCWSGSATVLPSGVPVIMYTGIDPDERQVQNVAYPVNLSDPYLREWYKPDYNPIINPDGGINASAFRDPTTAWYGPDGHWRLLVGSKVNMKGLAVLYRSRDFKKWVKAHHPLHSAHTGMWECPDFFPVAVAGGSRHYRRGVDTAELHDAAVAEEVKYVLKVSLDLTRYEYYTVGWYDHATDRYVPDAAFPDNDYGLRYDYGDFYASKSFYDPAKRRRIVWGWANESDTVPDDRRKGWAGIQAIPRKLWLSADGKQLVQWPVEELKALRAKHVNVTDKVIKKGNYFEVTGFKSVQSDVDMAFAIKDLSKAEEFDPAWRTDAEALCKKLGSDVDGGVGPFGLWALASGDLKERTAVFFRVFKANDSSHVVLMCNDPTRSSYESKIYRPTFAGFVDVDIAKNKQIALRTLIDHSVVESFGARGKTCILTRVYPRKAVGDDAHLFVFNNGESDVKVTNLDAWEMKTPKMNAEE

SEQ ID NO: 936 - protein, 586 aa, Oryza sativa; identical to SEQ ID NO: 935

SEQ ID NO: 937 - protein, 584 aa, Triticum sp.
MASAAAPLIVSLLCCTALAVHASHVVYPELQSLEATEVDKELRTGYHFQPPKHWINDPNGPMYYKGLYHLFYQYNPKGAVWGNIIWAHSVSTDLVDWVALEPGIYPSKPFDINGCWSGSATILPNGVPVIMYTGIDPKERQVQNVAYPANLSDPFLRKWVKPDYNPIINPDHGINASAFRDPTTAWYGPDGHWRLVVGSKENMRGIAVLYRSRDFRRWIKAHHSLHAGLTGMWECPDFYPVAVAGGRRHHRSGVDTRELHDSTVAAEVKYVLKVSLDVTRYEYYTIGWYDHAKDRYTPDLDFPDNDYGLRYDYGDFYASKSFYDPVKKRRVLWGWANESDTVPDDRNKGWAGIQAIPRKIFLSRSGRQLIQWPVEEIKSLRAKHVNVSNKAVKGGEYFKIDGFKSVQSDVEAAFVIKNLEKAEKFDTAWQTDAQGLCKKLNSHVKGGVGPFGLWLLASDDLKERTAVFFRVFKNNDTSYVVLMCNDPTRSSYESLIYRPTFAGFVNVDITKTKKIALRTLIDHSVVESFGAGGKTCILTRVYPRKAVGDNAHLFVFNNGESDIKLTNLRAWEMKTPTMNKRLGQ

SEQ ID NO: 938 - protein, 418 aa, Zea mays; identical to SEQ ID NO: 160

SEQ ID NO: 939 - protein, 282 aa, Oryza sativa
MSARSDFPIGDEEDEEEDDDDEMVSTGGGGGGKEEDAKEWVAQVEPGVLITFVSLPQGGNDLKRIRFSREMFNKWQAQRWWAENYDKVMELYNVQRFNHQAVPLPATPKSEDESSKEDSPVTPPLGKERLPRSFHRPLSGGGAVGSSSSDSLEHHSNHYCNGGHHHHGHQCYDSVGLVSTPKLSSISGAKTETSSMDASMRTSSSPEEVDRSGELSVSISNASDQEREWVEEDEPGVYITIRALPGGIRELRRVRFSRERFSEMHARLWWEENRARIHEQYL

SEQ ID NO: 940 - protein, 230 aa, Hordeum vulgare
MALVPSGSGSAPVIAEVEMNGGADQSAATVRATVVQASTVFYDTPATLDKAERLIAEAAGYGSQLVVFPEAFVGGYPRGSTFGFGISISITNPKDKGKGEFQKYYAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLKTAPVWPKVLRYIALPRLIRSQSGKLP

SEQ ID NO: 941 - protein, 360 aa, Hordeum vulgare
MALVPSGSGSAPVIAEVEMNGGADQSAATVRATVVQASTVFYDTPATLDKAERLIAEAAGYGSQLVVFPEAFVGGYPRGSTFGFGISISITNPKDKGKGEFQKYYAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIAMEGGCFVLSANQFCRRKDYPPPSEYAFAGLGEEPSPDTVVCPGGSVIISPSGEVLAGPNYDGEALITADLDMGEIVRAKFDFDVVGHYARPEVLGLVVDDQPHRPVSFTSAAEKAPAAKSDGAAKP

SEQ ID NO: 942 - protein, 361 aa, Zea mays; identical to SEQ ID NO: 162

SEQ ID NO: 943 - protein, 361 aa, Zea mays; identical to SEQ ID NO: 162

SEQ ID NO: 944 - protein, 362 aa, Oryza sativa
MAMVPSGSGGGPPVIAEVEMNGGADSGAATVRATVVQASTVFYDTPATLDKAERLIEEAAGYGSQLVVFPEAFVGGYPRGSTFGFGANISIGNPKDKGKEEFRKYHAAAIEVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRQVWQASMTHIALEGGCFVLSANQFCRRKDYPPPPEYVFSGLGEEPSPDTVVCPGGSVIISPSGEVLAGPNYEGEALITADLDLGEIVRAKFDFDVVGHYARPEVLSLVVNDQPHLPVSFTSAAVKTTAAKSDSTAKPY

SEQ ID NO: 945 - protein, 362 aa, Oryza sativa
MAMVPSGSGGGPPVIAEVEMNGGADSGAATVRATVVQASTVFYDTPATLDKAERLIEEAAGYGSQLVVFPEAFVGGYPRGSTFGFGANISIGNPKDKGKEEFRKYHAAAIEVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRQVWQASMTHIALEGGCFVLSANQFCRRKDYPPPPEYVFSGLGEEPSPDTVVCPGGSVIISPSGEVLAGPNYEGEALITADLDLGEIVRAKFDFDVVGHYARPEVLSLVVNDQPHLPVSFTSAAEKTTAAKSDSTAKPY

SEQ ID NO: 946 - protein, 363 aa, Sorghum bicolor
MALAPASSGKEPVISPPEVEMNGGADQPAATTVRASVVQASSVFYDTPATLDKAEKFIAEAAGNGSQLVLFPEAFIGGYPHGSTFGLAIGNRTAKGKEDFQKYHAAAIDVPGPEVSRLASLAGKYKVFLVMGVVERAGYTLYNTALFFDPLGKFLGKHRKLVPTALERTFWGFGDGSTLPVFDTPLGKIGALLCWENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLDLGEIVRAKFDFDVVGHYSRREVLSLVVKTDPKSAVSFTASADGERPASAGKKRDDSVYK

SEQ ID NO: 947 - protein, 312 aa, Sorghum bicolor
MALAPASSGKEPVISPPEVEMNGGADQPAATTVRASVVQASSVFYDTPATLDKAEKFIAEAAGNGSQLVLFPEAFIGGYPHGSTFGLAIGNRTAKGKEDFQKYHAAAIDVPGPEVSRLASLAGKYKVFLVMGVVERAGYTLYNTALFFDPLGKFLGKHRKLVPTALERTFWGFGDGSTLPVFDTPLGKIGALLCWENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLGKKPDRRFI

SEQ ID NO: 948 - protein, 222 aa, Sorghum bicolor
MALVPSGSGAGQVIAEVAMNGGADPNATTVRATVVQASTIFHDTPATLDKAERLIAEAAGYGSQLVVFPEAFIGGYPRGSTFGFGISISIINPKDKGKEAFRRYHAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGKSQSHVDKFPR

SEQ ID NO: 949 - protein, 361 aa, Sorghum bicolor
MALVPSGSGADQVIAEVAMNGGADPNATTVRATVVQASTIFHDTPATLDKAERLIAEAAGYGSQLVVFPEAFIGGYPRGSTFGFGISISIINPKDKGKEAFRRYHAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIALEGGCFVLSANQFCRRKDYPPPPEYEFAGLGEEPSADTVVCSGGSVIISPSGEVLAGPNYEGEALITADLDLGEIVRAKFDFDVVGHYSRPEVLSLVVNDQPHLPVSFTSAGEKTPAAKSDSDAKSY

SEQ ID NO: 950 - protein, 266 aa, Saccharum officinarum
MLLVQVPGPEVSRLASLAGKYKVFLVMGVIERAGYTLYNTALFFDPLGKYLGKHRKLVPTALERVFWGFGDGSTLPVFDTPLGKIGALLCWENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLDLGEIVRAKFDFDVVGHYSRPEVLSLVVKTDPKPAVSFTASSADGERASAGKGDDSLVAADMMATYL

SEQ ID NO: 951 - protein, 243 aa, Saccharum officinarum
  misc_feature (216)..(216): Xaa can be any naturally occurring amino acid
  misc_feature (229)..(229): Xaa can be any naturally occurring amino acid
  misc_feature (236)..(236): Xaa can be any naturally occurring amino acid
MALVPSGSGAGQVIAEVAMNGGADPNATTVRATVVQASTIFHDTPATLDKAERLIAEAAGYGSQLVVFPEAFIGGYPRGSTFGFGISISIINPKDKGKEAFRRYHAAAIDVPGPEVTRLAAMAGKYKVFLVMGVIEREGYTLYCSVLFFDPLGHYLGKHRKLMPTALERIIWGFGDGSTIPVYDTPLGKIGALICWENKMPLLRTALYGKNLGEIXTPSLILTGGPLFXTETFNWXERTTQFP

SEQ ID NO: 952 - protein, 360 aa, Triticum sp.
MALVPSGSGGAPVIAEVEMNGGADQSATIVRATVVQASTVFYDTPATLDKAERLIAEAAGYGSQLVVFPEAFVGGYPRGSTFGFGISISITNPKDKGKREFQKYYAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIAMEGGCFVLSANQFCRRQDYPPPSEYAFAGLGEEPSPDTVVCPGGSVIISPSGEVLAGPNYDGEALITADLDMGEIVRAKFDFDVVGHYSRPEVLSLVVDDQPHRPVSFTSAAEKAPAAKSDGTAKP

SEQ ID NO: 953 - protein, 240 aa, Zea mays; identical to SEQ ID NO: 164

SEQ ID NO: 954 - protein, 240 aa, Zea mays; identical to SEQ ID NO: 164

SEQ ID NO: 955 - protein, 235 aa, Oryza sativa
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 956 - protein, 240 aa, Oryza sativa
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLGLQLHP

SEQ ID NO: 957 - protein, 195 aa, Oryza sativa
MIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 958 - protein, 240 aa, Oryza sativa
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 959 - protein, 240 aa, Triticum sp.
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLMGQDLSGMGVKELQTLENQLEISLRCIRTKKDQILIDEIHELNHKGSLVHQENMELYKKINLIRQENAELQKKLSETEAATEVNRDSRTPYNFAVVEDANVSVDLELNSPQQQNDVEHTAPPKLGLQLHP

SEQ ID NO: 960 - protein, 240 aa, Zea mays; identical to SEQ ID NO: 164

SEQ ID NO: 961 - protein, 235 aa, Oryza sativa; identical to SEQ ID NO: 955

SEQ ID NO: 962 - protein, 240 aa, Oryza sativa; identical to SEQ ID NO: 956

SEQ ID NO: 963 - protein, 195 aa, Oryza sativa; identical to SEQ ID NO: 957

SEQ ID NO: 964 - protein, 240 aa, Oryza sativa; identical to SEQ ID NO: 958

SEQ ID NO: 965 - protein, 240 aa, Triticum sp.; identical to SEQ ID NO: 959

SEQ ID NO: 966 - protein, 106 aa, Zea mays
MKLSTVDPRRDLDVGCFVVPRDDVTMQANRLCAPATSSSSSAFCYAARSVVTNAKGFETPVPLANHGVAADDRPLERRTRDAGPQAGSLWEEDDLQSLVLMGFRSR

SEQ ID NO: 967 - protein, 126 aa, Zea mays
MLDEIINYVQSLQCQVEFLSMKLSTVDPRRELDVGCFVVPKDDVTMQANRLCAPATSSSSSAFCYAARSVVTNAKGFETPLPLANHGVAADDRPLERRTRDAGPQAGSLWEEDDLQSLVLMGFRGR

SEQ ID NO: 968 - protein, 126 aa, Zea mays; identical to SEQ ID NO: 165

SEQ ID NO: 969 - protein, 362 aa, Arabidopsis thaliana
MDPATNSPIMPIDLPIMHDSDRYDFVKDIGSGNFGVTRLMTDRVTKELVAVKYIERGEKIDENVQREIINHRSLRHPNIVRFKEVILTPSHLAIVMECAAGGELYERICNAGRFSEDEARFFFQQLISGVSYCHAMQICHRDLKLENTLLDGSPAPRLKICDFGYSKSSVLHSQPKSTVGTPAYIAPEILLQQEYDGKLADVWSCGVTLYVMLVGAYPFEDPQEPRDYRKTIQRILSVTYSIPEDLHLSPECRHLISRIFVADPATRITIPEITSDKWFLKNLPGDLMDENRMGSQFQEPEQPMQSLDTIMQIISEATIPTVRNRCLDDFMADNLDLDDDMDDFDSESEIDVDSSGEIVYAL

SEQ ID NO: 970 - protein, 346 aa, Arabidopsis thaliana
MHDSDRYDFVKDIGSGNFGVARLMTDRVTKELVAVKYIERGEKIDENVQREIINHRSLRHPNIVRFKEVILTPSHLAIVMEYAAGGELYERICNAGRFSEDEARFFFQQLISGVSYCHAMQICHRDLKLENTLLDGSPAPRLKICDFGYSKSSVLHSQPKSTVGTPAYIAPEILLRQEYDGKLADVWSCGVTLYVMLVGAYPFEDPQEPRDYRKTIQRILSVTYSIPEDLHLSPECRHLISRIFVADPATRITIPEITSDKWFLKNLPGDLMDENRMGSQFQEPEQPMQSLDTIMQIISEATIPTVRNRCLDDFMADNLDLDDDMDDFDSESEIDVDSSGEIVYAL

SEQ ID NO: 971 - protein, 361 aa, Arabidopsis thaliana
MDRAPVTTGPLDMPIMHDSDRYDFVKDIGSGNFGVARLMRDKLTKELVAVKYIERGDKIDENVQREIINHRSLRHPNIVRFKEVILTPTHLAIIMEYASGGELYERICNAGRFSEDEARFFFQQLLSGVSYCHSMQICHRDLKLENTLLDGSPAPRLKICDFGYSKSSVLHSQPKSTVGTPAYIAPEVLLRQEYDGKIADVWSCGVTLYVMLVGAYPFEDPEEPRDYRKTIQRILSVKYSIPDDIRISPECCHLISRIFVADPATRISIPEIKTHSWFLKNLPADLMNESNTGSQFQEPEQPMQSLDTIMQIISEATIPAVRNRCLDDFMTDNLDLDDDMDDFDSESEIDIDSSGEIVYAL

SEQ ID NO: 972 - protein, 361 aa, Arabidopsis thaliana; identical to SEQ ID NO: 971

SEQ ID NO: 973 - protein, 357 aa, Arabidopsis thaliana
MDRPAVSGPMDLPIMHDSDRYELVKDIGSGNFGVARLMRDKQSNELVAVKYIERGEKIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTDDDMEEDLESDLDDLDIDSSGEIVYAM

SEQ ID NO: 974 - protein, 362 aa, Arabidopsis thaliana
MDRPAVSGPMDLPIMHDSDRYELVKDIGSGNFGVARLMRDKQSNELVAVKYIERGEKIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTGSLDIDDDMEEDLESDLDDLDIDSSGEIVYAM

SEQ ID NO: 975 - protein, 362 aa, Arabidopsis thaliana; identical to SEQ ID NO: 974

SEQ ID NO: 976 - protein, 388 aa, Hordeum vulgare
MERGTMGDVPVMLDGDRYELVRSIGSGNFGVARLMRNRASGELVAVKYIDRGEKIDENVQREIINHRSLRHPNIIRFKEVILTPTHLAIVMEYASGGELFDRICTAGRFSVDEARFFFQQLISGVSYCHSMQVCHRDLKLENTLLDGSTTPRLKICDFGYSKSSVLHSQPKSTVGTPAYIAPEVLIKKEYDGKIADVWSCGVTLYVMLVGAYPFEDPENPKNFKMTIQKILGVQYSIPDYIHIPMDCRNLLSRIFVANPATVSAHSLHRHTHGFTRSALRNQDNALCYLSLQRITIPEIKNHPWFLKNLPADLMDGPTVSNQYEEPDQPMQNMNEIMQIMAEATIPAASALGINKFLPDGLDLDDDMDDLDSDLDIDMDSSGEIVYAM

SEQ ID NO: 977 - protein, 388 aa, Hordeum vulgare; identical to SEQ ID NO: 976

SEQ ID NO: 978 - protein, 293 aa, Hordeum vulgare
MERGTMGDVPVMLDGDRYELVRSIGSGNFGVARLMRNRASGELVAVKYIDRGEKIDENVQREIINHRSLRHPNIIRFKEVILTPTHLAIVMEYASGGELFDRICTAGRFSVDEARFFFQQLISGVSYCHSMQVCHRDLKLENTLLDGSTTPRLKICDFGYSKSSVLHSQPKSTVGTPAYIAPEVLIKKEYDGKIADVWSCGVTLYVMLVGAYPFEDPENPKNFKMTIQKILGVQYSIPDYIHIPMDCRNLLSRIFVANPATVSAHSLHRHTHGFTRSALKDLCCQPSYEDHHT

SEQ ID NO: 979 - protein, 361 aa, Hordeum vulgare
MDRAALTVGPGMDMPIMHDGDRYELVKDIGSGNFGVARLMRNRADGQLVAVKYIERGEKIDENVQREIINHRSLRHPNIIRFKEVILTPTHLAIVMEYASGGELFERICNAGRFSEDEARFFFQQLLSGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILSVQYSIPDYVHISSECRDLIAKIFVGNPATRITIPEIRNHPWFLKNLPADLVDDSTMSSQYEEPEQPMQSMDEIMQILAEATIPAAGSRINQFLNDGLDLDDDMDDLDSDADLDVESSGEIVYAM

SEQ ID NO: 980 - protein, 414 aa, Hordeum vulgare
MAGAAPDRAALTVGPGMDMPIMHDSDRYELVRDIGSGNFGVARLMRDRRTMELVAVKYIERGEKIDENVQREIINHRSLKHPNIIRFKEVILTPTHLAIVMEYASGGELFERICKNIRFSEDEARYFFQQLISGVSYCHSMQVCHRDLKLENTLLDGSPAPRLKICDFGYSKSSVLHSQPKSTVGTPAYIAPEVLLKKEYDGKIADVWSCGVTLYVMVVGAYPFEDPEEPKNFRKTIQRILSVQYSIPDNVDISPECRHLISRIFVGDPALRITIPEIRSHNWFLKNLPADLMDDDSMSSQYEEPEQPMQTMDQIMQILTEATIPPACSRINHILTDGFDMDDDMDDLESDSDLDIDSSGEIVYAMNWFLKNLPADLMDDDSMSSQYEEPEQPMQTMDQIMQILTEATIPPACS

SEQ ID NO: 981 - protein, 366 aa, Hordeum vulgare
MAGAAPDRAALTVGPGMDMPIMHDSDRYELVRDIGSGNFGVARLMRDRRTMELVAVKYIERGEKIDENVQREIINHRSLKHPNIIRFKEVILTPTHLAIVMEYASGGELFERICKNIRFSEDEARYFFQQLISGVSYCHSMQVCHRDLKLENTLLDGSPAPRLKICDFGYSKSSVLHSQPKSTVGTPAYIAPEVLLKKEYDGKIADVWSCGVTLYVMVVGAYPFEDPEEPKNFRKTIQRILSVQYSIPDNVDISPECRHLISRIFVGDPALRITIPEIRSHNWFLKNLPADLMDDDSMSSQYEEPEQPMQTMDQIMQILTEATIPPACSRINHILTDGFDMDDDMDDLESDSDLDIDSSGEIVYAM

SEQ ID NO: 982 - protein, 222 aa, Gossypium sp.
MDRADMMVGPGMDMPIMHDSDRYDFVKDIGSGNFGVARLMRDKITRELVAVKYIERGDKIDENVRREIINHRSLRHPNIVRFKEVILTPTHLAIVMEYASGGELFERICAAGRFNEDEARFFFQQLLSGVSYCHAMQVCHRDLKLENTLLDGSPAPRLKICDFGYSKSSVLHSQPKSTVGTPAYIAPEVLQRQEYDGKIADVWSCGVTLYVMLVGAYPFRGS

SEQ ID NO: 983 - protein, 349 aa, Gossypium sp.
MDRADLTVGPAMDMPIMHDSDRYDFVRDIGSGNFGVARLMRDKVTKELVAVKYIERGRKIDENVQREIINHRSLRHPNIVRFKEVILTPTHLAIVMEYASGGELFERICAAGRFNEDEARFFFQQLISGVSYCHAMQVCHRDLKLENTLLDGSPAPRLKICDFGYSKSSVLHSQPKSTVGTPAYIAPEVLLRKEYDGKIADVWSCGGTLYVMLVGAYPFEDPDEPRDFRKTIQRILSVQYAIPDVIQISPECQHLISRIFVADPSARITIPEIRNHEWFLKNLPADLMDENTMGSHFEEPDQPMQSTDTIMQIIAEATIPAAGAPGLNHYIVDNLDDEDMDDLDSEIGA

SEQ ID NO: 984 - protein, 206 aa, Gossypium sp.
MPPEVSFSSGFVLRVGSMRTRFIFLYLAFNFMSPFCFVFNLYISVILVQARFFFQQLISGVSYCHAMQVCHRDLKLENTLLDGSPAPRLKICDFGYSKSSVLHSHPKSTVGTPAYIAPEVLLRKEYDGKIADVWSCGVTLYVMLVGAYPFEDPDEPRDFRKTIQRILSVQYAIPDVVQISPECQHLISRIFVADPSAVSNFCLLQL

SEQ ID NO: 985 - protein, 254 aa, Gossypium sp.
MDRADLTVGPAMDMPIMHDSDRYDFVRDIGSGNFGVARLMRDKVTKELVAVKYIERGRKIDENVRREIINHRSLRHPNIVRFKEVILTPTHLAIVMEYASGGELFERICAAGRFNEDEARFFFQQLISGVSYCHAMQVCHRDLKLENTLLDGSPAPRLKICDFGYSKSSVLHSQPKSTVGTPAYIAPEVLLRKEYDGKIADVWSCGVTLYVMLVGAYPFEDPDEPRDFRKTIQEFLVSSMPFLMSSKYHLSVNI

SEQ ID NO: 986 - protein, 365 aa, Zea mays
MDRAALTVGPGMDMPIMHDGDRYELVRDIGSGNFGVARLMRNRADGQLVAVKYIDRGEKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKVADVWSCGVTLYVMLVGAYPFEDPDEPKNFRKTIQQRILGVQYSVPDYVHISPECQDLISRIFVANPSTRITMPEIRSHPWFLKNLPADLVDDSATTTSKQYEEPEQPMQGMDEIMQILGEATIPAAGSRGLNQFLNDGLDLDDDMEDLDSDADLDLESSGEIVYAM

SEQ ID NO: 987 - protein, 366 aa, Zea mays
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPATRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 988 - protein, 359 aa, Zea mays
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPATRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 989 - protein, 366 aa, Zea mays
MAGPAPDRAALTVGPGMDMPIMHDSDRYELVRDIGSGNFGVARLMRDRRTTELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMAVGAYPFEDPEEPKNFRKTIQRILNVQYAIPDYVNISPECRHLISRIFVGDPAMRITITEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 990 - protein, 363 aa, Populus spp
MDRSVMTVGPGMDMPIMHDGDRYELVRDIGSGNFGVARLMRDKQADGLVAVKYIERGEKIDENVQREIINHRSLRHPNIVRFKEVILTPTHLAIVMEYASGGELFERICNSGRFSEDEARFFFQQLISGVSYCHAMQVCHRDLKLENTLLDGSPAPRLKICDFGYSKSSVLHSQPTSTVGTPAYIAPEVLLKKEYDGKIADVWSCGVTLYVMLVGAYPFEDPDEPRNFRRTIHRILNVQYSIPDYVHISPECQHLISRIFVADPAKRITIPEIRNHDWFLKNFPADLMVENNMNNQFEEPDQPMQSIDEIMQIITEATIPAAGTPSLNQYLTGSLDIDDEMEEDLDSDPELDLDSSGEIVYAM

SEQ ID NO: 991 - protein, 228 aa, Populus spp
MQVCHRDLKLENTLLDGSPAPRLKICDFGYSKSSVLHSQPTSTVGTPAYIAPEVLLKKEYDGKIADVWSCGVTLYVMLVGAYPFEDPDEPRNFRSTIHRILNVQYSIPDYVHISPECQHLISRIFVADPAKRITIPEIRNHDWFLKNLPADLMVENNMNNQFEEPDQPMQSIDEIMQIITEATIPAAGTPSLNQYLTGSLDIDDEMEEDLDSDPELDLDSSGEIVYAM

SEQ ID NO: 992 - protein, 361 aa, Oryza sativa
MERAAAGPLGMEMPIMHDGDRYELVKEIGSGNFGVARLMRNRASGDLVAVKYIDRGEKIDENVQREIINHRSLRHPNIIRFKEVILTPTHLAIVMEYASGGELFERICSAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPEDPKNFRKTIQKILGVQYSIPDYVHISPECRDLITRIFVGNPASRITMPEIKNHPWFMKNIPADLMDDGMVSNQYEEPDQPMQNMNEIMQILAEATIPAAGTSGINQFLTDSLDLDDDMEDMDSDLDLDIESSGEIVYAM

SEQ ID NO: 993 - protein, 361 aa, Oryza sativa; identical to SEQ ID NO: 992

SEQ ID NO: 994 - protein, 362 aa, Oryza sativa
MDRAALTVGPGMDMPIMHDGDRYELVRDIGSGNFGVARLMRSRADGQLVAVKYIERGDKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILGVQYSIPDYVHISPECRDLIARIFVANPATRISIPEIRNHPWFLKNLPADLMDDSKMSSQYEEPEQPMQSMDEIMQILAEATIPAAGSGGINQFLNDGLDLDDDMEDLDSDPDLDVESSGEIVYAM

SEQ ID NO: 995 - protein, 362 aa, Oryza sativa; identical to SEQ ID NO: 994

SEQ ID NO: 996 - protein, 371 aa, Oryza sativa
MAAAGAGAGAPDRAALTVGPGMDMPIMHDSDRYELVRDIGSGNFGVARLMRDRRTMELVAVKYIERGEKIDDNVQREIINHRSLKHPNIIRFKEVILTPTHLAIVMEYASGGELFERICKNVRFSEDEARYFFQQLISGVSYCHSMQVCHRDLKLENTLLDGSPAPRLKICDFGYSKSSVLHSQPKSTVGTPAYIAPEVLLKKEYDGKTADVWSCGVTLYVMVVGAYPFEDPEEPKNFRKTIQRILNVQYSIPENVDISPECRHLISRIFVGDPSLRITIPEIRSHGWFLKNLPADLMDDDSMSSQYEEPDQPMQTMDQIMQILTEATIPPACSRINHILTDGLDLDDDMDDLDSDSDIDVDSSGEIVYAM

SEQ ID NO: 997 - protein, 371 aa, Oryza sativa; identical to SEQ ID NO: 996

SEQ ID NO: 998 - protein, 362 aa, Sorghum bicolor
MDRAALTVGPGMDMPIMHDGDRYELVRDIGSGNFGVARLMRNRADGQLVAVKYIERGEKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKVADVWSCGVTLYVMLVGAYPFEDPDEPKNFRKTIQRILGVQYSIPDYVHISPECQDLISRIFVANPATRITIPEIRNHPWFLKNLPADLMDDSTMSKQYEEPEQPMQSMDEIMQILAEATIPAAGSRGLNQFLNDGLDLDDDMEDLDSDADLDLESSGEIVYAM

SEQ ID NO: 999 - protein, 366 aa, Sorghum bicolor
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 1000 - protein, 366 aa, Sorghum bicolor; identical to SEQ ID NO: 999

SEQ ID NO: 1001 - protein, 322 aa, Glycine max
MRDKQTQELVAVKYIERGDKIDENVKREIINHRSLRHPNIIRFKEVILTPTHLAIVMEYASGGELFEKICNAGHFNEDEARFFFQQLISGVSYCHAMEVCHRDLKLENTLLDGSPALHLKICDFGYSKSSVLHSQPKSTVGTPAYIAPEVLLKQEYDGKIADVWSCGVTLFVMLVGSYPFEDPNDPKDFRKTIQRVLSVQYSIPDNVQVSPECRHLISRIFVFDPAERITIPEILQNEWFLKNLPPYLMDEKIMGNQFVESDQPMQNIDTIMQIISEATIPAAGTYSLDQFMADNIIDDDMDELDSDFELDVDSSGEIVYAI

SEQ ID NO: 1002 - protein, 236 aa, Glycine max
MDRAALTVGPGMDMPIMHDSDRYDLVRDIGSGNFGVARLMQDKQTKELVAVKYIERGDKIDENVKREIINHRSLRHPNIVRFKEVILTPTHLAIVMEYASGGELFEKICNAGRFTEDEARFFFQQLISGVSYCHAMQVCHRDLKLENTLLDGSPAPRLKICDFGYSKSSVLHSQPKSTVGTPAYIAPEVLLKQEYDGKIADVWSCGVTLFVMLVGSYPFEDPNDPKDFPEDNSESS

SEQ ID NO: 1003 - protein, 288 aa, Glycine max
MQDKQTKELVAVKYIERGDKIDENVKREIINHRSLRHPNIVRFKEVILTPTHLAIVMEYASGGELFEKICNAGRFTEDEARFFFQQLISGVSYCHAMQVCHRDLKLENTLLDGSPAPRLKICDFGYSKSSVLHSQPKSTVGTPAYIAPEVLLKQEYDGKLADVWSCGVTLYVMLVGAYPFEDPNEPKDFRKTIQRVLSVQYSIPDGVQISPECRHLISRIFVFDPAERITMSEIWNHEWFLKNLPADLMDEKIMGNQFEEPDQPMQKHRYDHADNFRSYRTSSWDLFF

SEQ ID NO: 1004 - protein, 360 aa, Glycine max
MDRAALTVGPGMDMPIMHDSDRYDLVRDIGSGNFGVARLMQDKQTKELVAVKYIERGDKIDENVKREIINHRSLRHPNIVRFKEVILTPTHLAIVMEYASGGELFEKICNAGRFTEDEARFFFQQLISGVSYCHAMQVCHRDLKLENTLLDGSPAPRLKICDFGYSKSSVLHSQPKSTVGTPAYIAPEVLLKQEYDGKLADVWSCGVTLYVMLVGAYPFEDPNEPKDFRKTIQRVLSVQYSIPDGVQISPECRHLISRIFVFDPAERITMSEIWNHEWFLKNLPADLMDEKIMGNQFEEPDQPMQSIDTIMQIISEATVPAVGTYSFDQFMEEQIYDLESESDAESDLDIDSSGEIVYAI

SEQ ID NO: 1005 - protein, 266 aa, Glycine max
MEYASGGELFEKICNAGRFNEDEARFFFQQLISGVSYCHAMEVCHRDLKLENTLLDGSPALHLKICDFGYSKSSVLHSQPKSTVGTPAYIAPEVLLKQEYDGKIADVWSCGVTLFVMLVGSYPFEDPNDPKDFRKTIQRVLSVQYSIPDNVQVSPECRHLISRIFVFDPAERITIPEILQNEWFLKNLPPYLMDEKIMGNQFVESDQPMQSIDTIMQIISEATIPAAGTYSLDQFMADNIIDDDMDELDSDFELDVDSSGEIVYAI

SEQ ID NO: 1006 - protein, 364 aa, Glycine max
MDRSAMTVGPGMDMPIMHDSDRYELVRDIGSGNFGVARLMRDKHTEELVAVKYIERGDKIDENVRREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKIADVWSCGVTLYVMLVGAYPFEDPEEPKNFRKTIHRILKVQYSIPDYVHISSECRHLISRIFVADPAQRISIPEIRNHEWFLKNLPADLMVENTMNNQFEEPDQPMQSIEEIMQIISEATIPAAGTQSLNQYLTGSLDIDDDDMDEDLETDPDLDIDSSGEIVYAM

SEQ ID NO: 1007 - protein, 336 aa, Saccharum officinarum
MAAPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTMDQIMQILTEATIPPFLFSQYKCPS

SEQ ID NO: 1008 - protein, 366 aa, Saccharum officinarum
MAAPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 1009 - protein, 355 aa, Helianthus annuus
  misc_feature (272)..(272): Xaa can be any naturally occurring amino acid
  misc_feature (294)..(294): Xaa can be any naturally occurring amino acid
MDRSMVPGMDLPIMHDSDRYDLVKDIGAGNFGVARLMRDKQTKELVAVKYIERGQKIDENVQREIINHRSLRHPNIVRFRELILTPTHLAIVMEYASGGELFDRISNAGRFNEDEARFFFQQLISGVSYCHSMQVCHRDLKLENTLLDGSPAPRLKICDFGYSKSSVLHSQPKSTVGTPAYIAPEVLLKQEYDGKIADVWSCGVTLYIMLIGGYPFEDPNEPKDFRKTIHRILHVQYSIPENIQISPECRHLISRIFVADPAQRITMDEIKXHDWFLKNHPANLMDEDKTMSNXFEEPDQPMQSVDTIMQIISEATIPPAGLYDLDMMDDDDLDDFDSDPDELDIDSSGEIIYAM

SEQ ID NO: 1010 - protein, 1184 aa, Nicotiana sp.
MDRVAMAVGAGMDVPIMHDSDRYELVKDIGSGNFGVARLMRDRQTNELVAVKYIERGEKIDENVKREIINHRSLRHPNIVRFKEVILTPTHLAIVMEYASGGELFERICNAGRFSEDEARFFFQQLISGVSFCHAMQVCHRDLKLENTLLDGSPAPRLKICDFGYSKSSVLHSQPKSTVGTPAYIAPEALLKKEYDGKIADVWSCGVTLYVMLVGAYPFEDPEEPKIFRKTIQRILNVQYSIPDYVHISPECRHLISRIFVADPAKRITIPEIKNHEWFLRNLPADLMDDNMTNNQFEEPDQRMQSIDEIMQIITEATIPAAGTNSLNHYLTGILDIDDDMEEDMESDPDLDIDSSGEIVYANVNDMVRTKLMDQTKPAECFVVLNYLVLPFGIHWFFLSIFFFISSRSSGSPPSVGVMGAPILSDLGTEILIPVCAVVGIAFSLFQWFLVSKVTLSADKSSGAADDKNGYAAESLIEEEEGINDHNVVQKCAEIQNAISEGATSFLFTEYQYVGVFMVAFAILIFLFLGSVEGFSTKNQPCTYDSTKTCKPALATAVFSTVSFLLGAVTSVVSGFLGMKIATYANARTTLEARKGVGKAFIVAFRSGAVMGFLLAANGLLVLYITILLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTVGIAVVTWIALPSTFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSDAHKAAVIGDTVGDPLKDTSGPSLNILIKLMAVESLVFAPFFATHGGLLFKLF

SEQ ID NO: 1011 - protein, 316 aa, Solanum lycopersicum
MTDKQTKELVAVKYIERGDKIDENVQREIINHRSLRHPNIIRFKEVILTPTHLAIVMEYASGGELFERISNAGRFNEDEARFFFQQLISGVSYCHSMQVCHRDLKLENTLLDGSPAPRLKICDFGYSKSALLHSQPKSTVGTPAYIAPEVLLRKEYDGKIADVWSCGVTLYVMLVGAYPFEDPDEPKDFRKTINRILSVQYSVPENIQISEECRHLISRIFVGDPAQRITMPEIRNHVWFLKNLPADLIDDRMISDQFEEPDQPMQSIDTIMQIISEATVPPIGLYNLEMMDDDMDDLDSEPDLDIDSSGEIIYAM

SEQ ID NO: 1012 - protein, 316 aa, Solanum lycopersicum; identical to SEQ ID NO: 1011

SEQ ID NO: 1013 - protein, 323 aa, Solanum lycopersicum
MRDRQTNELVAVKYIERGEKIDENVKREIINHRSLRHPNIVRFKEVILTPTHLAIVMEFASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKIADVWSCGVTLYVMLVGAYPFEDPEEPKNFRKTIQRILNVQYSIPDYVHISPECRHLISRIFVADPAKRISIPEIKNHEWFLKNLPADLMDNTTNNQFEEPDQRMQSIDEIMQIITEATIPAAGTNSLNHYLTGSLDIDDDMEEDLESDPDLDIDSSGEIVYAM

SEQ ID NO: 1014 - protein, 364 aa, Triticum sp.
  misc_feature (3)..(3): Xaa can be any naturally occurring amino acid
MEXGPAGTMGGPLSDVPAMLDGDRYELVRSIGSGNFGVARLMRNRASGELVAVKYIDRGEKIDENVQREIINHRSLRHPNIIRFKEVILTPTHLAIVMEYASGGELFERICTAGRFSVDEARFFFQQLISGVSYCHSMQVCHRDLKLENTLLDGSTTPRLKICDFGYSKSSVLHSQPKSTVGTPAYIAPEVLLKKEYDGKIADVWSCGVTLYVMLVGAYPFEDPENPKNFKVTIQKILGVQYSIPDYIHIPMDCRNLLSRIFVANPATRITIPEIKNHPWFLKNLPADLMDGPTVSNQYEEPDQPMQNMNEIMQIMAEATIPAAGALGINKFLPDGLDLDDDMDDLDSDLDIDMDSSGEIVYAM

SEQ ID NO: 1015 - protein, 266 aa, Triticum sp.
MEYASGGELFERICNAGRFSEDEARFFFQQLLSGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILSVQYSIPDYVHISSECRDLIAKIFVGNPATRITIPEIRNHPWFLKNLPADLVDDSTMSSQYEEPEQPMQSMDEIMQILAEATIPAAGSRINQFLNDGLDLDDDMDDLDSDADLDVESSGEIVYAM

SEQ ID NO: 1016 - protein, 366 aa, Triticum sp.
MAGAAPDRAALTVGPGMDMPIMHDSDRYELVRDIGSGNFGVARLMRDRRTMELVAVKYIERGEKIDENVQREIINHRSLKHPNIIRFKEVILTPTHLAIVMEYASGGELFERICKNIRFSEDEARYFFQQLISGVSYCHSMQVCHRDLKLENTLLDGSPAPRLKICDFGYSKSSVLHSQPKSTVGTPAYIAPEVLLKKEYDGKIADVWSCGVTLYVMVVGAYPFEDPEEPKNFRKTIQRILSVQYSIPDNVDISPECRHLISRIFVGDPALRITIPEIRSHNWFLKNLPADLMDDDSMSSQYEEPDQPMQTMDQIMQILTEATIPPACSRINHILTDGFDMDDDMDDLESDSDLDIDSSGEIVYAM

SEQ ID NO: 1017 - protein, 154 aa, Hordeum vulgare; identical to SEQ ID NO: 168

SEQ ID NO: 1018 - protein, 154 aa, Hordeum vulgare; identical to SEQ ID NO: 168

SEQ ID NO: 1019 - protein, 142 aa, Zea mays; identical to SEQ ID NO: 167

SEQ ID NO: 1020 - protein, 152 aa, Oryza sativa; identical to SEQ ID NO: 171

SEQ ID NO: 1021 - protein, 152 aa, Oryza sativa; identical to SEQ ID NO: 171

SEQ ID NO: 1022 - protein, 148 aa, Saccharum officinarum
  misc_feature (133)..(133): Xaa can be any naturally occurring amino acid
MGKLWTILTHLHSLAGPTVMLLYPLYASVQAMESPSKLDDEQWLAYWILYSFITLMEMVLESLIYWIPIWYELKLLFIAWLALPNFRGAAFIYDKFVREQLRKHGLTSAAASGKKDDGKSSSPSSKDKDKPKXKFLAFVTPKKDHEAY

SEQ ID NO: 1023 - protein, 139 aa, Triticum sp.
MSKLWTILTHLHTLAGPGVMLLYPLYASVQAMESPSKLDDEQWLAYWILYSFVTLVEMVLESLIYWIPIWYELKLLFLAWLALPNFRGAAFIYDRFVREQLRKHGLTNHPKSSSPSTSPKEKENAKSRFLSFVAPKKDH

SEQ ID NO: 1024 - protein, 362 aa, Arabidopsis thaliana; identical to SEQ ID NO: 974

SEQ ID NO: 1025 - protein, 362 aa, Arabidopsis thaliana; identical to SEQ ID NO: 974

SEQ ID NO: 1026 - protein, 357 aa, Arabidopsis thaliana; identical to SEQ ID NO: 973

SEQ ID NO: 1027 - protein, 361 aa, Arabidopsis thaliana
MDKYELVKDIGAGNFGVARLMRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIGDIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 1028 - protein, 361 aa, Arabidopsis thaliana
MDKYELVKDIGAGNFGVARLMRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIADIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 1029 - protein, 361 aa, Arabidopsis thaliana; identical to SEQ ID NO: 1027

SEQ ID NO: 1030 - protein, 388 aa, Hordeum vulgare; identical to SEQ ID NO: 976

SEQ ID NO: 1031 - protein, 388 aa, Hordeum vulgare; identical to SEQ ID NO: 976

SEQ ID NO: 1032 - protein, 361 aa, Hordeum vulgare; identical to SEQ ID NO: 979

SEQ ID NO: 1033 - protein, 342 aa, Hordeum vulgare
MDRYEVVRDIGSGNFGVAKLVRDVRTREHFAVKFIERGHKIDEHVQREIMNHRSLKHPNIIRFKEVVLTPTHLAIVMEYASGGELFQRICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTIARILSVQYSVPDYVRVSMDCIHLLSRIFVGNPQQRITIPEIKNHPWFLKRLPVEMTDEYQRGMQLADMNTPSQSLEEAMAIIQEAQKPGDNALGLAGQVACLGSMDLDDIDFDVDDIDIENSGDFVCPL

SEQ ID NO: 1034 - protein, 342 aa, Hordeum vulgare; identical to SEQ ID NO: 1033

SEQ ID NO: 1035 - protein, 341 aa, Hordeum vulgare
MERYEVIKDIGSGNFGVAKLVRDVRTKELFAVKFIERGHKIDENVQREIMNHRSLRHPNIVRFKEVVLTPTHLAIVMEYAAGGELFERICGSGKFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQSLEEIMAIIQEARIPGDGSKFAGQLSVPGLGSMELDDIDDVDADVEDSGDFVCAL

SEQ ID NO: 1036 - protein, 341 aa, Hordeum vulgare; identical to SEQ ID NO: 1035

SEQ ID NO: 1037 - protein, 357 aa, Hordeum vulgare
MERYELLKDIGAGNFGVARLMRNKETKELVAMKYIPRGLKIDENVAREIINHRSLRHPNIIRFKEVVVTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSCGVTLYVMLVGGYPFEDPDDPKNFRKTIGRIMSIQYKIPEYVHVSQDCKQLLASIFVANPAKRITMREIRNHPWFLKNLPRELTEAAQAMYYKRDNSAPTYSVQSVEEIMKIVEEAQKPPPSTTPVAGFGWAEEDEQEDGKKPEEEAEEDDEEDEYEKQLNEVRASGEFHIS

SEQ ID NO: 1038 - protein, 254 aa, Gossypium sp.; identical to SEQ ID NO: 985

SEQ ID NO: 1039 - protein, 332 aa, Gossypium sp.
MERYEALKELGAGNFGVARLVRDKRTKELVAVKYIERGKKIDENVQREIINHQSLRHPNIVRFKEVCLTPTHLAIVMEYAAGGELFEKICSAGRFSEDEESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVEEAKTPGDMSKVVDPALLAEMAELESDEEEADADDT

SEQ ID NO: 1040 - protein, 277 aa, Gossypium sp.
MEYAAGGELFDRICTAGRFSEDEARYFFQQLISGVNYCHSMQICHRDLKLENTLLDGSPAPRLKICDFGYSKSSLLHSRPKSTVGTPAYIAPEVLARREYDGKLADVWSCGVTLYVMLVGAYPFEDQADPRNFRKTIQRIMAVQYKIPDYVHISQDCKNLLSRIFVANPSRRITLKEIKNHPWFLKNLPRELTDTAQAAYYRSDNPTFSLQSIDEIMKIVEEARIPPPASVPVKGFGWGQDDDEEEDIDGEVKEDDEEDEYDKRVKEVHASGEYQIH

SEQ ID NO: 1041 - protein, 332 aa, Gossypium sp.; identical to SEQ ID NO: 1039

SEQ ID NO: 1042 - protein, 341 aa, Gossypium sp.
  misc_feature (340)..(340): Xaa can be any naturally occurring amino acid
MERYEILKDIGSGNFGVAKLVRDKRTGELYAVKYIERGPKIDEHVQREIMNHRSLKHPNIIKFKEVLLTPTHLAIVMEYAAGGELFERICNAGRFGEDEARFFFQQLISGVSYCHAMKICHRDLKLENTLLDGSSTPRLKICDFGYSKSSVLHSQPKSTVGTPAYIAPEVLSKKEYDGKIADVWSCGVTLYVMLVGAYPFEDPQDPRNFRKTIQRILSVHYSIPDYVRLSKDCRHLLSRIFVADPEKRITIPEIKQHPWFLKHLPKEFMGGEGGNLEKEEDEQFQSIEEVLSIIEEAREPGEGPKIGSQLLGGSMELDDLDTDADIDDIETSGDFVCALXV

SEQ ID NO: 1043 - protein, 356 aa, Gossypium sp.
MEKYELVKDIGSGNFGVARLMRNKETKELVAMKYIDRGHKIDENVAREIINHRSLRHPNIIRFKEVVLTPTHLAIVMEYAAGGELFERICNAGRFSEDEARYFFQQLISGVSYCHSMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTISRIMSVQYKIPDYVHISQDCRHLLSRIFVASPSRRISIKDIKSHPWFLKNLPRELTEAAQAAYYRKENPTFSLQSVDEIMKIVEEAKVAPRVSRSIGGFGWGGEEDGDAKEEDAEEEVEEEDEEDEYEKTVKEVHASGEIHVS

SEQ ID NO: 1044 - protein, 354 aa, Gossypium sp.
MEKYELVKDIGSGNFGVARLMRNKETKELVAMKYIDRGHKIDENVAREIINHRSLRHPNIIRFKEVVLTPTHLAIVMEYAAGGELFERICNAGRFSEDEARYFFQQLISGVSYCHSMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTISRIMSVQYKIPDYVHISQDCRHLLSRIFVASPSRRISIKDIKSHPWFLKNLPRELTEAAQAAYYRKENPTFSLQSVDEIMKIVEEAKVAPPVSRSIGGFGWGGEEDGDAREEDTEQEEEEEEDEYEKTVKEVHASGEVHVS

SEQ ID NO: 1045 - protein, 325 aa, Gossypium sp.
  misc_feature (6)..(6): Xaa can be any naturally occurring amino acid
  misc_feature (63)..(63): Xaa can be any naturally occurring amino acid
MEERYXPVKELGSGNFGVARLVKDKKTKELVAVKYIERGKKIDENVQREIINHRSLRHPNIIXFKEVVVTPTHLAIVMEYAAGGELFERICSAGRFSEDEARFFFQQLISGVSYCHSMQICHRDLKLENTLLDGSPTPRLKICDFGYSKSAVLHSQPKSTVGTPAYIAPEVLSRKEYDGKMDVWSCGVTLYVMLVGAYPFEDPKDPRNFRKTIGRIMSVQYTIPDYVRVSADCRQLLSCIFIANPAKRISIPEIKEHPWFLKNLPKELVEIEKTNYAESVRDQPSQSVEEIMRIIQEAKTTTAEGAKVGEQAAAGSSDPDDVEAD

SEQ ID NO: 1046 - protein, 355 aa, Vitis sp.
MEKYEMVKDLGSGNFGVARLMRVKETKELVAMKFIERGHKIDENVAREIINHRSLRHPNIIRFKEVVLTPTHLGIVMEYAAGGELFERICNAGRFSEDEARYFFQQLISGVSYCHSMQICHRDLELENTLLDGSPAPRLKICDFGYSKSSLLHSRPKSTVGTPAYIAPEVLSRREYDGKLADVWSCGVTLYVMLVGAYPFEDPDDPKNFRKTIGRIMAVQYKIPEYVHISQDCKQLLSRIFVANSSRRITIKEIKNHPWFLKNLPRELTESTQANYHQRDNLSFSLQSVEEIMKIVGEARIRCPSSRSIGGFGWGAEEGKGGEDDLDVEEEEIEEEDEYDKRVREVHASGEFHVS

SEQ ID NO: 1047 - protein, 355 aa, Vitis sp.; identical to SEQ ID NO: 1046

SEQ ID NO: 1048 - protein, 267 aa, Vitis sp.
MEERYDALKELGSGNFGVARLVRDKKTKELVAVKYIERGKKIDENVQREIINHRSLRHPNIVRFKEVLLTPTHLAIVMEYAAGGELFERICNAGRFSEDEARFFFQQLISGVSYCHSMEICHRDLKLENTLLDGSPMPRLKICDFGYSKSALLHSQPKSAVGTPAYIAPEVLSRKEYDGKIADVWSCGVTLYVMLVGAYPFEDPEDPRNFRKTIGRIMSVQYSIPDYVHVSAECRQLLSRIFVANPAKVTSSKANIELHLSSLSWNH

SEQ ID NO: 1049 - protein, 366 aa, Zea mays; identical to SEQ ID NO: 987

SEQ ID NO: 1050 - protein, 359 aa, Zea mays; identical to SEQ ID NO: 988

SEQ ID NO: 1051 - protein, 390 aa, Zea mays
MDRAALTVGPGMDMPIMHDGDRYELVRDIGSGNFGVARLMRNRADGQLVAVKYIDRGEKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKVADVWSCGVTLYVMLVGAYPFEDPDEPKNFQEDDPGSLSADARVYYIQCSKTADEIILVLQRILGVQYSVPDYVHISPECQDLISRIFVANPSTRITMPEIRSHPWFLKNLPADLVDDSATTTSKQYEEPEQPMQGMDEIMQILGEATIPAAGSRGLNQFLNDGLDLDDDMEDLDSDADLDLESSGEIVYAM

SEQ ID NO: 1052 - protein, 458 aa, Zea mays
MERYEVIRDIGSGNFGVTKLVRDVRTKELFAVKFIERGQKIDEHVQREIMNHRSLKHPNIIRFKEVISQTSWKGNVLVRISWMIGSYTRKCLQTVTFDAFKEEKYRLFIFFACTRCLSHTCEHCAGDCTFLEPHSFTTNTYLSFFLIKELSLSCTYLYDILSIHHWTPALDLSRSNHHKPFLGKLKYLVFQVVLTPTHLAIVMEYAAGGELFERICSAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVTMECGHLLSRIFVGNPEQRITIPEIKKHPWFLKNLPIEMTDEYQQSMQLADMNTPGQSLEEAMAIIQEARKPGDAMNLAGQLPCLGSVDLDDIDFDDIDDIDT

SEQ ID NO: 1053 - protein, 175 aa, Zea mays
MEYAAGGELFERICSAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVTMECGHLLSRIFVGNPEQVHFF

SEQ ID NO: 1054 - protein, 342 aa, Zea mays
MERYEVIRDIGSGNFGVTKLVRDVRTKELFAVKFIERGQKIDEHVQREIMNHRSLKHPNIIRFKEVVLTPTHLAIVMEYAAGGELFERICSAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVTMECGHLLSRIFVGNPEQRITIPEIKKHPWFLKNLPIEMTDEYQQSMQLADMNTPGQSLEEVMAIIQEARKPGDAMNLAGQLPCLGSVDLDDIDFDDIDDIDTENSGDFVCAV

SEQ ID NO: 1055 - protein, 175 aa, Zea mays; identical to SEQ ID NO: 1053

SEQ ID NO: 1056 - protein, 316 aa, Zea mays
MKLITAENSRRGSNRDYYIFVSEFKFITISKLQIKREGLVFQVVLTPTHLAIVMEYAAGGELFERICNAGRFSEDEARFFFQQLISGVSYCHSMQICHRDLKLENTLLDDSIAPRLKICDFGYSKSSVLHSQPKSTVGTPAYIAPEVLARKEYDGKVADVWSCGVTLYVMLVGAYPFEDPDEPKNFRKTLTRIISVQYAVPDFVRVSMECRHLLSRIFVAKPEQRITIPEIKNHPWFLKNLPIEMTDEYQMNLQLVDMNVPSQSLEEIMSIILEARKPGDGLKHAGQLPGLGSMELDDIDVDDIDVEDSGDFVCAL

SEQ ID NO: 1057 - protein, 339 aa, Zea mays
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDDSIAPRLKICDFGYSKSSVLHSQPKSTVGTPAYIAPEVLARKEYDGKVADVWSCGVTLYVMLVGAYPFEDPDEPKNFRKTLTRIISVQYAVPDFVRVSMECRHLLSRIFVAKPEQRITIPEIKNHPWFLKNLPIEMTDEYQMNLQLVDMNVPSQSLEEIMSIILEARKPGDGLKHAGQLPGLGSMELDDIDVDDIDVEDSGDFVCAL

SEQ ID NO: 1058 - protein, 377 aa, Zea mays
MEKYELLKDIGSGNFGVARLMRNKDTKELVAMKYIPRGLKIDENVAREIINHRSLRHHNIIRFKEVVLTPTHLAIVMEYAAGGELFDRICSAGRFSEDEARYFFQQLICGVSYCHFMRCATANFVWIHSQQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGRIVSIQYQIPEYVHISQDCRQLLARIFVANPAKRITIREIRNHPWFLKNLPRELTEAAQAKYYKKDNSAPTFSDQTVEEIMKIVEEARTPPQSSTPVAGFGWAEEEEQEDGKRSDDDEQYGEDEDYDGEDEYDKQVKHVHASGDFQHLLK

SEQ ID NO: 1059 - protein, 356 aa, Zea mays
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHSMQICHRDLKLENTLLDGSPAPRLKICDFGYSKSSLLHSKPKSTVGTPAYIAPEVLSRREYDGKTADVWSCGVTLYVMLVGGYPFEDPDDPKNFRKTIGRIMSIQYKIPEYVHVSQDCKELLSRIFVANSAKRITIREIRNHPWFLKNLPRELTEAAQAMYYKKDNSAPTYSVQSVEEIMKIVEKARTPPPSSTPVAGFGWAEEDEQEDSKEPDEEHEDGEDEYEKQVKQVHASGEFHLSC

SEQ ID NO: 1060 - protein, 356 aa, Zea mays; identical to SEQ ID NO: 1059

SEQ ID NO: 1061 - protein, 430 aa, Zea mays
MEERYEALKELGAGNFGVARLVRDKRTKELVAVKYIERGKKIDENVQREIINHQSLRHPNIVRFKEVCLTPTHLAIVMEYAAGGELFEKICSAGRFSEDEVCFGLIFVILSAYFLAPNHVKLMLCAPYVVNANSPGISSNADIRGQLLPFYGTVLLPKVNKSMNSGSVSFNELTNETQEICHRDLKLENTLLDGSPTPRVKICDFGYSKVLYTDTAPALLCVLTLPATDFSCVVESVTNFASVAFQSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVEEAKTPGDMSKVVDPALLAEMAELESDEEEADADDTY

SEQ ID NO: 1062 - protein, 338 aa, Populus spp
  misc_feature (88)..(88): Xaa can be any naturally occurring amino acid
  misc_feature (137)..(137): Xaa can be any naturally occurring amino acid
MEERYETIKEIGSGNFGVARLVRDKKTMELVAVKYIERGKKIDENVQREIINHRSLRHPNIVRFKEVLLTPTHLAIVMEYAAGGELFXRICSAGRFSEDETRFFFQQLISGVSYCHSMEICHRDLKLENTLLDGSPXPRLKICDFGYSKSALLHSQPKSTVGTPAYIAPEVLSRKEYDGKISDVWSCGVTLYVMLVGAYPFEDPEDPRNFRKTIGRIMSVQYSIPDYVRVSADCKHLLSRIFVANPAKRITIPEIKQHPWFLKNLPKELVEIEKTNFTKSERDQPAQSVEEIMSIIQEAKTPGEGGKVAEHAFAGTSDDLDVDLDSEVDVSGDIMPSF

SEQ ID NO: 1063 - protein, 338 aa, Populus spp
MEERYETIKELGTGNFGVARLVRDKKTMELVAVKYIERGKKIDENVQREIINHRSLRHPNIVRFKEVLLTPTHLAIVMEYAAGGELFVRICSAGRFSEDETRFFFQQLISGVSYCHSMEICHRDLKLENTLLDGSPTPRLKICDFGYSKSALLHSQPKSTVGTPAYIAPEVLSRKEYDGKISDVWSCGVTLYVMLVGAYPFEDPEDPRNFRKTIGRIMSVQYSIPDYVRVSADCKHLLSRIFVANPAKRITIPEIKQHPWFLKNLPKELVEIEKTNFTKSERDQPAQSVEEIMSIIQEAKTPGEGGKVAEHAFAGTSDDLDVDLDSEVDVSGDIMPSF

SEQ ID NO: 1064 - protein, 361 aa, Oryza sativa; identical to SEQ ID NO: 992

SEQ ID NO: 1065 - protein, 361 aa, Oryza sativa; identical to SEQ ID NO: 992

SEQ ID NO: 1066 - protein, 362 aa, Oryza sativa; identical to SEQ ID NO: 994

SEQ ID NO: 1067 - protein, 362 aa, Oryza sativa; identical to SEQ ID NO: 994

SEQ ID NO: 1068 - protein, 342 aa, Oryza sativa
MERYEVMRDIGSGNFGVAKLVRDVATNHLFAVKFIERGLKIDEHVQREIMNHRSLKHPNIIRFKEVVLTPTHLAIVMEYAAGGELFERICNAGRFSEDEARFFFQQLISGVSYCHSMQVCHRDLKLENTLLDGSVTPRLKICDFGYSKSSVLHSQPKSTVGTPAYIAPEVLSRKEYDGKVADVWSCGVTLYVMLVGAYPFEDPDDPRNFRKTITRILSVQYSIPDYVRVSADCRHLLSRIFVGNPEQRITIPEIKNHPWFLKNLPIEMTDEYQRSMQLADMNTPSQSLEEVMAIIQEARKPGDAMKLAGAGQVACLGSMDLDDIDDIDDIDIENSGDFVCAL

SEQ ID NO: 1069 - protein, 342 aa, Oryza sativa; identical to SEQ ID NO: 1068

SEQ ID NO: 1070 - protein, 339 aa, Oryza sativa
MERYEVIKDIGSGNFGVAKLVRDVRTKELFAVKFIERGQKIDENVQREIMNHRSLRHPNIVRFKEVVLTPTHLAIVMEYAAGGELFERICSAGRFSEDEARFFFQQLISGVSYCHSMQICHRDLKLENTLLDGSIAPRLKICDFGYSKSSLLHSQPKSTVGTPAYIAPEVLARKEYDGKVADVWSCGVTLYVMLVGAYPFEDPDEPRNFRKTITRILSVQYMVPDYVRVSMECRHLLSRIFVANPEQRITIPEIKNHPWFLKNLPIEMTDEYQMSVQMNDINTPSQGLEEIMAIIQEARKPGDGSKFSGQIPGLGSMELDDVDTDDIDVEDSGDFVCAL

SEQ ID NO: 1071 - protein, 325 aa, Oryza sativa
MKSPPLLSPPPPLPHRTTPRLPPLLSQSTRWSLQFLASLLCWISSSCSASCSALVFGLSGRCAEAERFGRSQESLVRAGELSWEVGMERYEVIKDIGSGNFGVAKLVRDVRTKELFAVKFIERGQKIDENVQREIMNHRSLRHPNIVRFKEVVLTPTHLAIVMEYAAGGELFERICSAGRFSEDEARFFFQQLISGVSYCHSMQICHRDLKLENTLLDGSIAPRLKICDFGYSKSSLLHSQPKSTVGTPAYIAPEVLARKEYDGKVADVWSCGVTLYVMLVGAYPFEDPDEPRNFRKTITVSYPTTIYTYEIPHSILLTSAHAAS

SEQ ID NO: 1072 - protein, 396 aa, Oryza sativa
MEKYELLKDIGSGNFGVARLMRNRETKELVAMKYIPRGLKIDENVAREIINHRSLRHPNIIRFKEVVLTPTHLAIVMEYAAGGELFDRICSAGRFSEDESRYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKEFQKNNRGNNSPTSASLNSNFKRHTNVQIYYAHIFILQRIVSIQYKIPEYVHISQDCRQLLSRIFVANPAKRITIREIRNHPWFMKNLPRELTEAAQAKYYKKDNSARTFSDQTVDEIMKIVQEAKTPPPSSTPVAGFGWTEEEEQEDGKNPDDDEGDRDEEEGEEGDSEDEYTKQVKQAHASCDLQKS

SEQ ID NO: 1073 - protein, 365 aa, Oryza sativa
MEKYELLKDIGSGNFGVARLMRNRETKELVAMKYIPRGLKIDENVAREIINHRSLRHPNIIRFKEVVLTPTHLAIVMEYAAGGELFDRICSAGRFSEDESRYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGRIVSIQYKIPEYVHISQDCRQLLSRIFVANPAKRITIREIRNHPWFMKNLPRELTEAAQAKYYKKDNSARTFSDQTVDEIMKIVQEAKTPPPSSTPVAGFGWTEEEEQEDGKNPDDDEGDRDEEEGEEGDSEDEYTKQVKQAHASCDLQKS

SEQ ID NO: 1074 - protein, 359 aa, Oryza sativa
MERYELLKDIGAGNFGVARLMRNKETKELVAMKYIPRGLKIDENVAREIINHRSLRHPNIIRFKEVVVTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSCGVTLYVMLVGAYPFEDPDDPKNFRKTIGRIMSIQYKIPEYVHVSQDCRQLLSRIFVANPAKRITIREIRNHPWFLKNLPRELTEAAQAMYYKKDNSAPTYSVQSVEEIMKIVEEARTPPRSSTPVAGFGWQEEDEQEDNSKKPEEEQEEEEDAEDEYDKQVKQVHASGEFQLS

SEQ ID NO: 1075 - protein, 359 aa, Oryza sativa; identical to SEQ ID NO: 1074

SEQ ID NO: 1076 - protein, 334 aa, Oryza sativa
MEERYEALKELGAGNFGVARLVRDKRSKELVAVKYIERGKKIDENVQREIINHRSLRHPNIIRFKEVCLTPTHLAIVMEYAAGGELFEQICTAGRFSEDEARYFFQQLISGVSYCHSLEICHRDLKLENTLLDGSPTPRVKICDFGYSKSALLHSKPKSTVGTPAYIAPEVLSRKEYDGKVADVWSCGVTLYVMLVGSYPFEDPGDPRNFRKTISRILGVQYSIPDYVRVSSDCRRLLSQIFVADPSKRITIPEIKKHTWFLKNLPKEISEREKADYKDTDAAPPTQAVEEIMRIIQEAKVPGDMAAADPALLAELAELKSDDEEEAADEYDTY

SEQ ID NO: 1077 - protein, 334 aa, Oryza sativa; identical to SEQ ID NO: 1076

SEQ ID NO: 1078 - protein, 366 aa, Sorghum bicolor; identical to SEQ ID NO: 999

SEQ ID NO: 1079 - protein, 366 aa, Sorghum bicolor; identical to SEQ ID NO: 999

SEQ ID NO: 1080 - protein, 362 aa, Sorghum bicolor; identical to SEQ ID NO: 998

SEQ ID NO: 1081 - protein, 339 aa, Sorghum bicolor
  misc_feature (142)..(142): Xaa can be any naturally occurring amino acid
MERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMQICHRDLKLENTLLDGSIAPRLKIXDFGYSKSSVLHSQPKSTVGTPAYIAPEVLARKEYDGKVADVWSCGVTLYVMLVGAYPFEDPDEPKNFRKTLTRILSVQYAVPDFVRVSMECRHLLSRIFVAIPEQRITIPEIKNHPWFLKNLPIEMTDEYQMNLQLVDMNGPSQSLEEIMTIIQEARKPGDGLKHSGQLPGLGSMELDDIDVDDIDVEDSGDFVCAL

SEQ ID NO: 1082 - protein, 344 aa, Sorghum bicolor
MERYEVIRDIGSGNFGVAKLVRDVTTKELFAVKFIERGQKIDEHVQREIMNHRSLKHPNIIRFKEVVLTPTHLAIVMEYAAGGELFERICNAGRFSENEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVSTECRHLLSRIFVGNPEQRITIPEIKNHPWFLKNLPVEMTDEYQQSMQQLADMNTPGQSLEEVMAIIQEAQKPGDAVSLAGQLPSCLGSMDLDDIDLDDIDDIDIENSGDFVCAV

SEQ ID NO: 1083 - protein, 333 aa, Sorghum bicolor; identical to SEQ ID NO: 175

SEQ ID NO: 1084 - protein, 256 aa, Sorghum bicolor
MEYAAGGELFEKITTAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSECRRLLSQIFVADPSKRITIPEIKHHPWFLKNLPREISEREKANYKDSDAAEPAQAVDEIMRIVQEAKTPGDMSKVVDSALLAEMAELESDDEEADADDAY

SEQ ID NO: 1085 - protein, 360 aa, Glycine max; identical to SEQ ID NO: 1004

SEQ ID NO: 1086 - protein, 236 aa, Glycine max; identical to SEQ ID NO: 1002

SEQ ID NO: 1087 - protein, 364 aa, Glycine max; identical to SEQ ID NO: 1006

SEQ ID NO: 1088 - protein, 345 aa, Glycine max
MERYEIIKDIGSGNFGVAKLVKEKWSGELYAIKFIERGFKIDEHVQREIINHRSLKHPNIIRFKELLLTPTHLAIVMEYASGGELFERICSAGRFSEDEARYFFQQLISGVSYCHSMEICHRDLKLENTLLDGSSAPRLKICDFGYSKSSVLHSQPKSTVGTPAYIAPEVLSRREYDGKVADVWSCGVTLYVMLVGAYPFEDPEDPRNFRKTLQRILSVHYSIPDYVRISKECRHLLSRIFVANPEKRITIPEIKMHPWFLKNLPLEFMDESEGVLQNDDHVNEDSSEITQSIEEILAIIQEARKPSEGPKVSEQFVGGSMDLDDIDADADIDDIETSGDFVCAL

SEQ ID NO: 1089 - protein, 345 aa, Glycine max
MERYEIIKDIGSGNFGVAKLVKEKWSGELYAIKFIERGFKIDEHVQREIINHRSLKHPNIIRFKELLLTPTHLAIVMEYASGGELFERICSAGRFSEDEARYFFQQLISGVSYCHSMEICHRDLKLENTLLDGSSAPRLKICDFGYSKSSVLHSQPKSTVGTPAYIAPEVLSRREYDGKVADVWSCGVTLYVMLVGAYPFEDPEDPRNFRKTLQRILSVHYSIPDYVRISKECRHLLSRIFVANPEKRITIPEIKMHPWFLKNLPLEFMDEGEGVLQNDDHVNEESSEITQSIEEILAIVQEARKPGEGPKVGEQFVGGSMDLDDIDADADIDDIETSGDFVCAL

SEQ ID NO: 1090 - protein, 349 aa, Glycine max
MDKYEAVKDLGAGNFGVARLMRNKVTKELVAMKYIERGPKIDENVAREIMNHRSLRHPNIIRYKEVVLTPTHLAIVMEYAAGGELFERICSAGRFSEDEARYFFQQLISGVHFCHTMQICHRDLKLENTLLDGSPAPRLKICDFGYSKSSLLHSRPKSTVGTPAYIAPEVLSRREYDGKLADVWSCAVTLYVMLVGAYPFEDQDDPRNFRKTIQRIMAVQYKIPDYVHISQDCRHLLSRIFVANPLRRITIKEIKNHPWFLRNLPRELTESAQAIYYQRDSPNFHLQSVDEIMKIVGEARNPPPVSRPVKGFGWEGEEDLDEEVEEEEDEDEYDKRVKEVHASGEFQIS

SEQ ID NO: 1091 - protein, 306 aa, Glycine max
MEERYETLKELGSGNFGVARLAKDKETGELVAIKYIERGKKIDANVQREIVNHRSLRHPNIIRFKEVFLTPTHLAIVLEYAAGGELFERICNAGRLSEDEARCFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISCIFVANPAKRISISEIKQHLWFRKNLPREIIEPERRGYEETQKDPTKPKCGRNHADHTRSKDKNPHW

SEQ ID NO: 1092 - protein, 351 aa, Glycine max
MDKYEAVKDLGAGNFGVARLMRNKETKELVAMKYIERGQKIDENVAREIINHRSLRHPNIIRFKEVVLTPTHLAIVMEYAAGGELFERICNAGRFSEDEARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKSHPWFLKNLPRELTESAQAVYYQRGNPSFSIQSVEEIMKIVGEARDPPPVSRPVKGFGWDGEEDEGEEDVEEEEDEEDEYDKRVKEVHASGEFQIS

SEQ ID NO: 1093 - protein, 351 aa, Glycine max; identical to SEQ ID NO: 1092

SEQ ID NO: 1094 - protein, 325 aa, Glycine max
MEERYEPLKELGAGNFGVARLAKDKKTGELVAVKYIERGKKIDENVQREIINHRSLRHPNIIRFKEVLLTPTHLAIVLEYASGGELFERICTAGRFSEDEARYFFQQLISGVSYCHSMEICHRDLKLENTLLDGNPSPRLKICDFGYSKSALLHSQPKSTVGTPAYIAPEVLSRKEYDGKISDVWSCGVTLYVMLVGAYPFEDPEDPRNFRKTIGRIIGVQYSIPDYVRVSSDCRNLLSRIFVADPAKRINISEIKQYLWFMKNMPKEIIEAERKGFEETKKDQPSQNVEEIMQIIQEARIPGQGSKAGEGGQAGTGTSDVVLVG

SEQ ID NO: 1095 - protein, 336 aa, Glycine max; identical to SEQ ID NO: 176

SEQ ID NO: 1096 - protein, 336 aa, Glycine max
MEERYEPLKELGAGNFGVARLAKDKKTGELVAVKYIERGKKIDENVQREIINHRSLRHPNIIRFKEVLLTPTHLAIVLEYASGGELFERICTAGRFSEDEARYFFQQLISGVSYCHSMEICHRDLKLENTLLDGNPSPRLKICDFGYSKSALLHSQPKSTVGTPAYIAPEVLSRKEYDGKISDVWSCGVTLYVMLVGAYPFEDPEDPRNFRKTIGRIIGVQYSIPDYVRVSSDCRNLLSRIFVADPAKRITIPEIKQYPWFLKNMPKEIIEAERKGFEETTKDQPNQKVEEIMRIIQAARIPGQGSKAGEGGQAGTGSLDIEDDEEIDVSGDYEQV

SEQ ID NO: 1097 - protein, 344 aa, Glycine max
MEERYEPLKELGAGNFGVARLAKDKKTGELVAVKYIERGKKIDENVQREIINHRSLRHPNIIRFKEVLLTPTHLAIVLEYASGGELFERICTAGRFSEDEARYFFQQLISGVSYCHSMEICHRDLKLENTLLDGNPSPRLKICDFGFSKSALLHSQPKSTVGTPAYIAPEVLSRKEYDGKVSDVWSCGVTLYVMLVGAYPFEDPEDPRNFRKTIGRIIGVQYSIPDYVRVSSDCRNLLSRIFVADPAKRISISEIKQYPWFLKNMPKEIIEAERKGFEETTKDQPNQKVEEIMRIIQAARIPGQGSKAGEGGQAGTGTSDAVHGDEANEEVDINDHYAKYLTLD

SEQ ID NO: 1098 - protein, 366 aa, Saccharum officinarum; identical to SEQ ID NO: 1008

SEQ ID NO: 1099 - protein, 381 aa, Saccharum officinarum
MERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMVYSYLQLTCDLKAEHLHNAIFVSLLQQICHRDLKLENTLLDGSIAPRLKICDFGYSKVLQIINFSKQLADKTLYKSYSDFFPSPLSSVLHSQPKSTVGTPAYIAPEVLARKEYDGKVIPVWSCGVTLYVMLVGAYPFEDPDEPKNFRKTLTRILSVQYAVPDFVRISMECRHLLSRFVANPEQRITIPEIKNHPWFLKNLPIEMTDEYQRNLQPVDMNAPSQSLDEIMAIIQEARKPGDGLKHSGQLPGLGSMELDDIDVDDID

SEQ ID NO: 1100 - protein, 317 aa, Saccharum officinarum
  misc_feature (200)..(200): Xaa can be any naturally occurring amino acid
MEKYELLKDIGSGNFGVARLMRNKDTKELVAMKYIPRGLKIDENVAREIINHRSLRHPNIIRFKEVVLTPTHLAIVMEYAAGGELFDRICNAGRFSEDEARYFFQQLICGVSYCHFMHSQQICHRDLKLENTLLDGSPAPRLKICDFGYSKSSLLHSKPKSTVGTPAYIAPEVLSRREYDGKMADVWSCGVTLYVMLVGXYPFEDPDDPKNFRKTIGRIVSIQYQIPEYVHISQDCRELTEAAQAKYYKKDNSAPTFSDQTVEEIMKIVEEARTPPQSFTPVAGFGWAEEEEQEDGKKLEDDEQDGEDEEYDCEDEY

SEQ ID NO: 1101 - protein, 392 aa, Saccharum officinarum
  misc_feature (189)..(189): Xaa can be any naturally occurring amino acid
  misc_feature (194)..(194): Xaa can be any naturally occurring amino acid
  misc_feature (198)..(198): Xaa can be any naturally occurring amino acid
  misc_feature (204)..(204): Xaa can be any naturally occurring amino acid
  misc_feature (208)..(208): Xaa can be any naturally occurring amino acid
MEERYEALKELGAGNFGVARLVRDKRTKELVAVKYIERGKKIDENVQREIINHQSLRHPNIVRFKEVCLTPTHLAIVMEYAAGGELFEKITTAGRFSEDESRYFFQQLISGVSYCHSVVWFCFEKLTSSRIVECKFNELQMQEICHRDLKLENTLLDGSPTPRVKICDFGYSKVLYMDLRLLCILTLPXTDFSXVVEXVTNFAXVAFXSGLLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVQEAKTPGDMSKVVDPALLAEIAELESDDEEADADDTY

SEQ ID NO: 1102 - protein, 356 aa, Nicotiana sp.
MDKYELVKDIGSGNFGVARLMRHKETKELVAMKYIERGHKIDENVAREIINHRSLRHPNIIRFKEVLVTPTHLAIVMEYAAGGELFERICNAGRFSEDEARYFFQQLISGVHYCHNMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTIQRIMAVQYKIPDYVHISQDCRHLLSRIFVANPARRITIKEIKSHPWFLKNLPRELTEAAQAAYYRRENPTFSLQSVEEIMKIVEEAKTPAPASRSVSGFGWGGEEEEEEKEGDVEEEEEDEEEEDEYEKQVKQAHESGEVRLT

SEQ ID NO: 1103 - protein, 356 aa, Nicotiana sp.; identical to SEQ ID NO: 1102

SEQ ID NO: 1104 - protein, 339 aa, Nicotiana sp.
MEEKYELLKELGAGNFGVARLVKDKKTKELFAVKYIERGKKIDENVQREIINHRSLGHPNIIRFKEVLVTPSHLAIVMEYAAGGELFARICSAGRFSEDEARFFFQQLISGVSYCHAMEISCWDLKLENTLLDGSASPRVKICDFGYSKSGLLHSQPKSTVGTPAYIAPEVLSRKEYDGKIADVWSCGVTLYVMLVGAYPFEDPEDPKNFRKTIGRIMSAQFSIPDYVRISADCKNLLSRIFVANPSKRITIPEIKKHPWFLKNLPKDLMDGEHSKYEEASEQLQQSVEEIMRIIQEAKIPGEVSKPEGQATERTTEQDDTEDDLESEIDSSNDFAVYV

SEQ ID NO: 1105 - protein, 339 aa, Nicotiana sp.
MEEKYELLKELGTGNFGVARLVKDKKTKELFAVKYIERGKKIDENVQREIINHRSLGHPNIIRFKEVLVTPSHLAIVMEYAAGGELFARICSAGRFSEDEARFFFQQLISGVSYCHAMEICHRDLKLENTLLDGSASPRVKICDFGYSKSGLLHSQPKSTVGTPAYIAPEVLSRKEYDGKIADVWSCGVTLYVMLVGAYPFEDPEDPKNFRKTIGRIMSAQYSIPDYVRISADCKNLLSRIFVANPSKRITIPEIKKHPWFLKNLPKDLMDGEHSKYEEASEQLQQSVEEIMRIIQEAKIPGEVSKPEGQATAGTAEPDDTEDDLESEIDSSNDFAVYV

SEQ ID NO: 1106 - protein, 339 aa, Nicotiana sp.; identical to SEQ ID NO: 1105

SEQ ID NO: 1107 - protein, 323 aa, Solanum lycopersicum; identical to SEQ ID NO: 1013

SEQ ID NO: 1108 - protein, 337 aa, Solanum lycopersicum
MERYEIQKDIGSGNFGVAKLVKDKWSGELFAVKYIERGKKIDEHVQREIMNHRSLRHPNIIRFKEVFLTPAHLAIVMEYASGGELFERICSAGRFSEDEARFFFQQLISGVSYCHSMQICHRDLKLENTLLDGSSTQCLKICDFGYSKSAALHSQPKSTVGTPAYIAPEVLSRKEYDGKIADVWSCGVTLYVMLVGAYPFEDPDDPRNFKKTITRILSVQYSIPYYVRVSKECNHLLSRIFVADPEKRITIEEIKKHPWFLKNLPKEFMKKGEEASLVQMNSEEKPLQSIEEALAIIQEARKPGEGSKASDYFVNSSISMDLDDFDTDADLDDEIDT

SEQ ID NO: 1109 - protein, 339 aa, Solanum lycopersicum
MEEKYELLKELGAGNFGVARLVKDKKTKELLAVKYIERGKKIDENVQREIINHRSLRHPNIVRFKEVLVTPSHLAIVMEYAAGGELFGRICSAGRFSEDEARFFFQQLISGVSYCHTMEICHRDLKLENTLLDGSPSPRLKICDFGYSKSGLLHSQPKSTVGTPAYIAPEVLSRKEYDGKIADVWSCGVTLYVMLVGAYPFEDPEDPKNFRKTIGRIMSAQHSIPDYVRVTPDCRNLLSRIFVANPSKRITIPEIKKHPWFLKNLPKELMDVEHARFEEASEQLQQSVEEIMKMIQEAKVPGVVSKSEGKDPAGTAEQDDLEEDLESEIDSSNDFAVYV

SEQ ID NO: 1110 - protein, 339 aa, Solanum lycopersicum; identical to SEQ ID NO: 1109

SEQ ID NO: 1111 - protein, 266 aa, Triticum sp.; identical to SEQ ID NO: 1015

SEQ ID NO: 1112 - protein, 342 aa, Triticum sp.
MDRYEVVRDIGSGNFGVAKLVRDVRTKEHFAVKFIERGHKIDEHVQREIMNHRSLKHPNIIRFKEVVLTPTHLAIVMEYASGGELFQRICNAGRFSEDEGRFFFQQLISGVSYCHSMQVCHRDLKLENTLLDGSVAPRLKICDFGYSKSSVLHSQPKSTVGTPAYIAPEVLSRREYDGKVADVWSCGVTLYVMLVGAYPFEDPDEPRNFRKTITRILSVQYSVPDYVRVSMDCIHLLSRIFVGNPQQRITIPEIKNHPWFLKRLPVEMTDEYQRSMHLADMNTPSQSLEEAMAIIQEAQKPGDNALGIAGQVACLGSMDLDDIDFDIDDIDVESSGDFVCPL

SEQ ID NO: 1113 - protein, 341 aa, Triticum sp.
MERYEVIKDIGSGNFGVAKLVRDVRTKELFAVKFIERGHKIDENVQREIMNHRSLRHPNIVRFKEVVLTPTHLAIVMEYAAGGELFERICSSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYAVPDYVRISMECRHLLSRIFVANPEQRITIQEIKNHPWFLKNLPIEMTDEYQMSLHMVGVNAPPQTLEEVMAIIQEARIPGDGSKFAGQLSVPGLGSMELDDIDDVDADVEDSGDFVCAL

SEQ ID NO: 1114 - protein, 377 aa, Triticum sp.
MERYEVIKDIGSGNFGVAKLVRDVRTKELFAVKFIERGHKIDENVQREIMNHRSLRHPNIVRFKEVVLTPTHLAIVMEYAAGGELFERICGSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITVSSSNNQLHHILIPFCFTQRMPLIMLGSKSFIRSLQRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDADVEDSGDFVCAL

SEQ ID NO: 1115 - protein, 341 aa, Triticum sp.
MERYEVIKDIGSGNFGVAKLVRDVRTKELFAVKFIERGHKIDENVQREIMNHRSLRHPNIVRFKEVVLTPTHLAIVMEYAAGGELFERICGSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDADVEDSGDFVCAL

SEQ ID NO: 1116 - protein, 341 aa, Triticum sp.
MERYEVIKDIGSGNFGVAKLVRDVRTKELFAVKFIERGHKIDENVQREIMNHRSLRHPNIVRFKEVVLTPTHLAIVMEYAAGGELFERICGSGRFSENEARFFFQQLLSGVSYCHSMQICHRDLKLENTLLDGSEAPRLKICDFGYSKSSVLHSQPKSTVGTPAYIAPEVLSRREYDGKVADVWSCGVTLYVMLVGAYPFEDPDEPKNFRKTITRILSYNTAVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDADVEDSGDFVCAL

SEQ ID NO: 1117 - protein, 335 aa, Triticum sp.
MERYELLKDIGAGNFGVARLMRNKETKELVAMKYTPNIIRFKEVVVTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSCGVTLYVMLVGGYPFEDPDDPKNFRKTIGRIMSIQYKIPEYVHVSQDCKQLLASIFVANPAKRITMREIRNHPWFLKNLPRELTEAAQAMYYKRDNSAPTYSVQSVEEIMKIVEEAQKPPPSTTPVAGFGWAEEDEQEDGKKPEEEAEEEDEEDEYEKQLNEVRASGEFHIS

SEQ ID NO: 1118 - protein, 342 aa, Triticum sp.
MEERYEALKELGTGNFGVARLVRDKSTKELVAVKYIERGKKIDENVQREIINHRSLRHPNIIRFKEVCVTPTHLAIVMEYAAGGELFERICTAGRFSEDEARYFFQQLLSGVSYCHSMEICHRDLKLENTLLDGSPTPRVKICDFGYSKSALLHSKPKSTVGTPAYIAPEVLSRKEYDGKVADVWSCGVTLYVMLIGSYPFEDPEDPRNFRKTISRILGVQYSIPDYVRVSSDCRRLLSQIFTADPSKRITIAEIKKLPWYLKSLPKEIAERDRANFKEPETETGTAAAAAQPVEEIMRIIQEAKAPGEMSKSSADAALLAELAELQSDDEEEGPGAEGETY

SEQ ID NO: 1119 - protein, 226 aa, Arabidopsis thaliana
MSQCIDGFKHVCSSFFRCFDIDIYKQSGGLGDPELLARETVFSVSEIEALYELFKKISSAVIDDGLINKEEFQLALFKTNKKESLFADRVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQVEDT

SEQ ID NO: 1120 - protein, 230 aa, Arabidopsis thaliana
MSQCIDGFKHVCSSFFRCFDIDIYKQSGGLGDPELLARETVFSVSEIEALYELFKKISSAVIDDGLINKEEFQLALFKTNKKESLFADRYQSQVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQVEDT

SEQ ID NO: 1121 - protein, 226 aa, Arabidopsis thaliana
MSQCIDGFKHVCSSFFRCFDIDIYKQSGGLGDPELLARETVFSVSEIEALYELFKKISSAVIDDGLINKEEFHLSFFNTNKIYNFFSYLVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQVEDT

SEQ ID NO: 1122 - protein, 226 aa, Arabidopsis thaliana
MSQCVDGIKHLCTSVLGCFDLDLYKQSGGLGDPELLARDTVFSVSEIEALYELFKKISSAVIDDGLINKEEFQLALFKTNKKESLFADRVFDLFDTKHNGILGFEEFARALSVFHPNAPIDDKIHFSFQLYDLKQQGFIERQEVKQMVVATLAESGMNLKDTVIEDIIDKTFEEADTKHDGKIDKEEWRSLVLRHPSLLKNMTLQYLKDITTTFPSFVFHSQVEDT

SEQ ID NO: 1123 - protein, 226 aa, Arabidopsis thaliana; identical to SEQ ID NO: 1122

SEQ ID NO: 1124 - protein, 223 aa, Brassica sp.; identical to SEQ ID NO: 177

SEQ ID NO: 1125 - protein, 225 aa, Hordeum vulgare
MVQCLDGVKHLLAVLFKCCDLELKQPRGLEDPQVLARETVFSVSEVEALYELFKKISSAVIDDGLINKEEFQLALFKTSKKESLFADRVFDLFDTKHNGILGFEEFARALSVFHPNASVEEKIDFSFQLYDLKQQGFIERQEVKQMVVATLAESGMNLSDEIIENIIDKTFEEADTKHDGKIDREEWHNLVLRHPSLLKNMTLQYLKDITTTFPSFVFHSQVDDT

SEQ ID NO: 1126 - protein, 225 aa, Hordeum vulgare; identical to SEQ ID NO: 1125

SEQ ID NO: 1127 - protein, 225 aa, Hordeum vulgare
MLQCLEGVRHLCGVLLKCCHIDLKHPKGLEDPEVLARETVFSVSEVEALYELFKKISSAVIDDGLINKEEFQLALFKTSKKESLFADRVFDLFDTKHNGILGFEEFARALSVFHPSAAPDEKINFSFQLYDLKQQGFIERQEVKQMVVATLAESGMNLSDEVIESIIDKTFEEADTKHDGKIDKEEWHNLVQRHPSLLKNMTLQYLKDITTTFPSFVFHSQVADT

SEQ ID NO: 1128 - protein, 225 aa, Hordeum vulgare; identical to SEQ ID NO: 1127

SEQ ID NO: 1129 - protein, 226 aa, Hordeum vulgare
MVDFPEGLRRLAGLLLKCCDLDIPNRPKGLEDPERLARETVFSVNEIEALYELFKKISSAVVDDGVINKEEFQLALFKTNRKDSMFADRVFDLFDTKHNGILEFEEFVRALSVFHPNAPVDDKIDFAFKLYDLKQQGFIEKQEVKQMVVATLAESGMNLSDEVIEGIIDKTFEEADTKHDGKIDKEEWRNLVLRHPSLLKNMTLPYLRDITTTFPSFVFNSQVEDA

SEQ ID NO: 1130 - protein, 226 aa, Hordeum vulgare; identical to SEQ ID NO: 1129

SEQ ID NO: 1131 - protein, 249 aa, Gossypium sp.
MLQCVAGVKHLFASVLQCCDIDLYKQSRGLGDPELLARETVFSVSEIEALYELFKKISSAVIDDGLINKEEFQLALFKTNKKESLFADRVFDLFDTKHNGILGFEEFARALSVFHPNAPIEDKIECMCCLHRDLYLHLWPSFINLEIRFSFQLYDLKQQGFIERQEVKQMVVATLAESGMNLSDDVIESIIDKTFEEADTKHDGRIDKEEWRSLVIRHPSLLKNMTLQYLKDITTTFPSFVFHSQVDDT

SEQ ID NO: 1132 - protein, 226 aa, Gossypium sp.
MLQCVAGVKHLFASVLQCCDIDLYKQSRGLGDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 1133 - protein, 226 aa, Gossypium sp.
MLQCIDGLKHLFASVLQCCDIDLYKQSRGLVDPELLARETVFSVSEIEALYELFKKISSAVIDDGLINKEEFQLALFKTNKKESLFADRVFDLFDTKHNGILGFEEFARALSVFHPNAPIDDKIDFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 1134 - protein, 249 aa, Gossypium sp.
MLQCLDGLKHLFASVLQCCDIDLYKQSRGLEDPELLARETVFSVSEIEALYELFKKISSAVIDDGLINKEEFQLALFKTNKKESLFADRVFDLFDTKHNGILGFEEFARALSVFHPNAPIDDKIECMCCLHRDLYLHLWPSFINLEIRFSFQLYDLKQQGFIERQEVKQMVVATLAESGMNLSDDVIESIIDKTFEEADTKHDGRIDKEEWRSLVLRHPSLLKNMTLQYLKDITTTFPSFVFHSQVDDT

SEQ ID NO: 1135 - protein, 226 aa, Gossypium sp.; identical to SEQ ID NO: 1133

SEQ ID NO: 1136 - protein, 189 aa, Gossypium sp.
MLQCLDGLKHLFASVLHCCDIDLCKQSRGLEDPELLARETVFSVSEIEALYELFKKISSAVIDDGLINKEEFQLALFKTNKKESLFADRVFDLFDTKHNGILGFEEFARALSVFHPNAPIDDKIDFSFQLYDLKQQGFIERQEVKQMVVATLAESGMNLSDDVIESIIDKVIIQFDLIEVVLLLKFYGV

SEQ ID NO: 1137 - protein, 189 aa, Gossypium sp.; identical to SEQ ID NO: 1136

SEQ ID NO: 1138 - protein, 226 aa, Vitis sp.
MLQCLEGFKHLIASLLRCCDLDLYNQARGLQDPEVLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1139 - protein, 226 aa, Vitis sp.
MLQCLEGVKHLCAVVVNCCDADLYKQPKGLEDPEALARETVFSVSEIEALYELFKKISSAVIDDGLINKEEFQLALFKTNKKESLFADRVFDLFDTKHNGILDFEEFARALSVFHPNAPIEDKIDFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1140 - protein, 258 aa, Vitis sp.
MIDSETWWAGIFTLPLQAFSAGMEHFDVAKNIMLQCLEGFKHLIASLLRCCDLDLYNQARGLQDPEVLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1141 - protein, 225 aa, Zea mays
MVQCLDGVRQLLAVLLNCCDVELKQPRGLQDPQVLARETVFSVSEVEALYELFKRISSAVIDDGLINKEEFQLALFKTNKKESLFADRVFDLFDTKHSGILGFEEFARALSVFHPNAPLDEKIDFSFRLYDLKQQGYIERQEVKQMVVATLAESGMNLSDEIVESIIDKTFEEADTKHDGRIDKEEWRNLVIRHPSLLKNMTLQYLKDITTTFPSFVFHSQVDDN

SEQ ID NO: 1142 - protein, 225 aa, Zea mays
  misc_feature (79)..(79): Xaa can be any naturally occurring amino acid
MVQCLDGVRQLLAVLLNCCDVELKQPPGLEDPQVLARETVFSVSEVEALYELFKKISSAVIDDGLINKEEFQLALFKTXKKESLFADRVFDLFDTKHSGILGFEEFARALSVFHPNAPLDEKIDFSFRLYDLKQQGYIERQEVKQMVVATLAESGMNLSDEIVESIIDKTFEEADTKHDGRIDKEEWRSLVSRHPSLLKNMTLQYLKDITTTFPSFVFHSQVDDN

SEQ ID NO: 1143 - protein, 225 aa, Zea mays
MLQCLDGVKQLLGVLLKCCHIDLKQPNGLEDPEVLARETVFSVSEVEALYELFKKISSAVIDDGLINKEEFQLALFKTNKKESFFADRVFDLFDTKHNGILGFEEFARALSVFHPNAPLDEKIEFSFQLYDLKQQGFIERQEVQQMVVATLAESGMNLLDEVIESIIDKTFEEADTKHDGKIDKEEWRNLVVRHPSLLKNMTLQYLKDITTTFPSFVFHSQVDDT

SEQ ID NO: 1144 - protein, 225 aa, Zea mays
MLQCLDGVKQLLGVLLKCCHIDLKQPNGLEDPEVLARETVFSVSEVEALYELFKKISSAVIDDGLINKEEFQLALFKTNKKESLFADRVFDLFDTKHNGILGFEEFARALSVFHPNAPLDEKIEFSFQLYDLKQQGFIERQEVKQMVVATLAESGMNLLDEVIESIIDKTFEEADTKHDGKIDKEEWRNLVVRHPSLLKNMTLQYLKDITTTFPSFVFHSQVDDT

SEQ ID NO: 1145 - protein, 225 aa, Zea mays
MVQCLDGVRQLLAVLLKCCDVELKQPPGLEDPQVLARETVFSVSEVEALYELFKKISSAVIDDGLINKEEFQLALFKTSKKESLFADRVFDLFDTKHNGILGFEEFARALSVFHPNAPLDEKIDFSFRLYDLKQQGYIERQEVKQMVVATLAESGMNLSDEIVESIIDKTFEEADTKHDGRIDKEEWRSLVSRHPSLLKNMTLQYLKDITTTFPSFVFHSQVDDN

SEQ ID NO: 1146 - protein, 162 aa, Zea mays
MYYLQDEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 1147 - protein, 223 aa, Zea mays; identical to SEQ ID NO: 177

SEQ ID NO: 1148 - protein, 272 aa, Prunus persica
  misc_feature (180)..(180): Xaa can be any naturally occurring amino acid
  misc_feature (187)..(187): Xaa can be any naturally occurring amino acid
  misc_feature (247)..(247): Xaa can be any naturally occurring amino acid
MVKRFVLIFTCFRILSFKDRLKGNFMICFSFFHVNQVWSVLICRKYHVAVHRGVKAFMCFPTEVCDLELYKQSRGLEDPEILARETVFSVSEIEALYELFKKISSAVIDDGLINKEEFQLALFKTNKKESLFADRVFDLFDTKHNGILGFEEFARALSVFHPNAPIDDKIEFSFQLYDLXQQGFIEXQEVKQMVVATLAESGMNLSDDVIESIIDKTFEEADTKHDGRIDKEEWRSLVLRHPSLLKXMTLQYLKDITTTFPSFVFHSQVDDT

SEQ ID NO: 1149 - protein, 226 aa, Populus spp
MAQCLDRIKHFCAAVASCCDADLYKQNRGLEDPEALARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1150 - protein, 222 aa, Populus spp
MYQCVERSITSLLRCLDIDLYKSRGLEDPELLARETVFSVSEIEALYELFKKISSAVIDDGLINKEEFQLALFKTNKKESLFADRVFDLFDTKHNGILGFEEFARALSVFHPNAPIEEKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1151 - protein, 222 aa, Populus spp
MFQCVEGFITSLLRCFDIDLYKSRGLEDPELLARETVFSVSEIEALYELFKKISSAVIDDGLINKEEFQLALFKTNKKESLFADRVFDLFDTKHNGILGFEEFARALSVFHPNAPIDDKIAFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1152 - protein, 226 aa, Populus spp
MVQCLDGLKHLCAAIANCCDADLYKQPRGLEDPEDLARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1153 - protein, 226 aa, Populus spp
MVQCLDGLKHLCAAIANCCDADLYKQPRGLEDPEVLARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 1154 - protein, 225 aa, Oryza sativa
MVQCLDGVRQLLAVVFKCCDLELKQPRGLEDPQVLARETVFSVSEVEALYELFKKISSAVIDDGLINKEEFQLALFKTSKKESLFADRVFDLFDTKHNGILGFDEFARALSVFHPSAPLDEKIDFSFQLYDLKQQGYIERQEVKQMVVATLAESGMNLSDEIIESIIDKTFEEADTKHDGRIDKEEWRNLVLRHPSLLKNMTLQYLKDITTTFPSFVFHSQVDDT

SEQ ID NO: 1155 - protein, 231 aa, Oryza sativa
MLDGVRQLLAVVFKCCDLELKQPRGLEDPQVLARETVFSVGPREGDRLQRDEVEALYELFKKISSAVIDDGLINKEEFQLALFKTSKKESLFADRVFDLFDTKHNGILGFDEFARALSVFHPSAPLDEKIDFSFQLYDLKQQGYIERQEVKQMVVATLAESGMNLSDEIIESIIDKTFEEADTKHDGRIDKEEWRNLVLRHPSLLKNMTLQYLKDITTTFPSFVFHSQVDD

SEQ ID NO: 1156 - protein, 225 aa, Oryza sativa
MLQCLEGVKQLCGVLLKCCDLDLKQPKGLEDPEILARETVFSVSEVEALYELFKKISSAVIDDGLINKEEFQLALFKTNKKESLFADRVFDLFDTKHNGILGFEEFARALSVFHPNAPLDEKIDFSFQLYDLKQQGFIERQEVKQMVVATLAESGMNLSDEVIESIIDKTFEEADTKHDGKIDKEEWRNLVLRHPSLLKNMTLQYLKDITTTFPSFVFHSQVDDT

SEQ ID NO: 1157 - protein, 225 aa, Oryza sativa; identical to SEQ ID NO: 1156

SEQ ID NO: 1158 - protein, 226 aa, Oryza sativa [sequence omitted]

SEQ ID NO: 1159 - protein, 226 aa, Oryza sativa [sequence omitted]

SEQ ID NO: 1160 - protein, 225 aa, Sorghum bicolor
MVQCLDGVRQLLAVLLKCCDVDLKQPRGLEDPQVLARETVFSVSEVEALYELFKKISSAVIDDGLINKEEFQLALFKTSKKESLFADRVFDLFDTNTNGILGFEEFARALSVFHPNAPVDEKIDFSFRLHDLKQQGYIERQEVKQMVVATLAESGMNLSDEIVESIIDKTFEEADTKHDGRIDKEEWRSLVIRHPSLLKNMTLQYLKDITTTFPSFVFHSQVDDN

SEQ ID NO: 1161 - protein, 221 aa, Sorghum bicolor
MLDGVRQLLAVLLKCCDVDLKQPRGLEDPQVLARETVFSVSEVEALYELFKKISSAVIDDGLINKEEFQLALFKTSKKESLFADRVFDLFDTKHNGILGFEEFARALSVFHPNAPVDEKIDFSFRLHDLKQQGYIERQEVKQMVVATLAESGMNLSDEIVESIIDKTFEEADTKHDGRIDKEEWRSLVIRHPSLLKNMTLQYLKDITTTFPSFVFHSQVDD

SEQ ID NO: 1162 - protein, 223 aa, Sorghum bicolor
MVDFVRRLASVLLKCCDLDIPSRPKGLEDPERLARETVFNVNEIEALYELFKKISSAVVDDGLINKEEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 1163 - protein, 226 aa, Glycine max
MVQCLDGLKHLCAALINCCDADSSKQPTGLENPEVLARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 1164 - protein, 226 aa, Glycine max; identical to SEQ ID NO: 1163

SEQ ID NO: 1165 - protein, 302 aa, Glycine max
MLRCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDLEDNFSHGFFLWAAWPLLYKKGHGRQPCFYLTFVISLNNVFCFVDSFAGILLSFFLQTSRHIWFPFFKFQKQDSKVV

SEQ ID NO: 1166 - protein, 226 aa, Glycine max
MLRCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 1167 - protein, 225 aa, Saccharum officinarum
MLQCLDGVKHLLGVLLKCCDIDLKQPKGLEDPEVLARETVFSVSEVEALYELFKKISSAVIDDGLINKEEFQLALFKTSKKESLFADRVFDLFDTKHNGILGFEEFARALSVFHPNAPLDEKIEFSFQLYDLKQQGFIERQEVKQMVVATLAESGMNLSDEVIESIIDKTFEEADTKHDGKIDKEEWRNLVVRHPSLLKNMTLQYLKDITTTFPSFVFHSQVDDT

SEQ ID NO: 1168 - protein, 225 aa, Helianthus annuus
MSQCLEGIKHLCASLLYCCDFELSKQSQGLDDPAVLASQTVFSVSEIEALYELFKKISSSAVNDDGLINKEKFQLALFKTNKKESLFADRVFDLFDTKHNGILGFEEFARALSVFHPNAPIDDKINFSFQLYDLKQQGYIERQEVKQMVVATLAESGMNLSDEVIESIIDKTFEEADTKHDGKIDQEEWRNLVLRHPSLLKNMTLQYLKDITTTFPSFVFHSRVE

SEQ ID NO: 1169 - protein, 226 aa, Helianthus annuus
MSQCLEGVRHLFASLLHCCDLELYKQSRGLEDPEILARETVFSVSEIEALYELFKKISSAVIDDGLINKEEFQLALFKTNKKESLFADRVFDLFDTKHNGILGFEEFARALSVFHPNAPVDDKIEFSFQLYDLKQQGFIERQEVKQMVVATLAESGMNLSDDVIESIIDKTFEEADTKHDGKIDKEEWRSLVLRHPSLLKNMTLQYLKDITTTFPSFVFHSRVEDT

SEQ ID NO: 1170 - protein, 213 aa, Nicotiana sp.
MLQCLDGIKHLGASLSKCCDLDRQSTGFEDPEILARETVFSVSEIEALYELFKKISSAVVDDGLINKEEFQLALFKTIKKESLFADRVFDLFDTKHNGILGFEEFARALSVFHPNAPIDDKIEFSFQLYDLKQQGFIERQEVKQMVVPTLAESGTNLSDEVIESIIDKTFEEADTKHDGKIDKEEWRSLVLQHPSLLKNMTLQYLKDITTTFP

SEQ ID NO: 1171 - protein, 222 aa, Nicotiana sp.
  misc_feature (17)..(17): Xaa can be any naturally occurring amino acid
  misc_feature (71)..(71): Xaa can be any naturally occurring amino acid
MSHCLEGIKHLGASLLXCCDRQSTGLEDPEILARETVFSVSEIEALYELFVKISSAVIDDGLINKEEFQLXLFKTSKKESLFADRVFDLFDTKHNGLLGFEEFARALSVFHPNAPIDDKIGFSFQLYDLKQQGFIERQEVKQMVVATLAETGMNLSDEIIESIIDKTFEEADTKHDGKIDKEEWRNLVLRHPSLLKNMTLQYLKDITTTFPSFVFHSRVPDT

SEQ ID NO: 1172 - protein, 224 aa, Nicotiana sp.
MLQCLDGIKHLGASLSKCCDLDRQSTGFEDPEILARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSRVEDT

SEQ ID NO: 1173 - protein, 217 aa, Solanum lycopersicum
  misc_feature (166)..(168): Xaa can be any naturally occurring amino acid
  misc_feature (196)..(196): Xaa can be any naturally occurring amino acid
  misc_feature (202)..(202): Xaa can be any naturally occurring amino acid
MLQCLGSYLSRCCDLDFKQSGGLDDPEILARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFXXXDTKHDGKIDKEEWRNLVLRHPSLLKNMXLQYLKXITTTFPSFVFHSRVE

SEQ ID NO: 1174 - protein, 224 aa, Solanum lycopersicum
  misc_feature (205)..(205): Xaa can be any naturally occurring amino acid
MLQCLEGIKHLGASLSKCCDLDRQSTAFEDPEILARETVFSVSEIEALYELFKKISSAVVDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLQHPSLLKNMTLQYXKDITTTFPSFVFHSRVEDS

SEQ ID NO: 1175 - protein, 219 aa, Solanum lycopersicum
MLQCLGSYLSRCCDLDFKQSGGLDDPEILARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSRVEDT

SEQ ID NO: 1176 - protein, 225 aa, Triticum sp.; identical to SEQ ID NO: 1125

SEQ ID NO: 1177 - protein, 225 aa, Triticum sp.
MLQCLEGVRHLGGVLLKCCDIDLKQPKGLEDPEVLARETVFSVSEVEALYELFKKISSAVIDDGLINKEEFQLALFKTSKKESLFADRVFDLFDTKHNGILGFEEFARALSVFHPSAPPDEKIDFSFQLYDLKQQGFIERQEVKQMVVATLAESGMNLSDEVIESIIDKTFEEADTKHDGKIDKEEWRNLVLRHPSLLKNMTLQYLKDITTTFPSFVFHSQVDDT

SEQ ID NO: 1178 - protein, 226 aa, Triticum sp.
MVDFPEGLRRLAALLLKCCDLDIPNRPKGLEDPERLARETVFSVNEIEALYELFKKISSAVVDDGVINKEEFQLALFKTNRKDSMFADRVFDLFDTKHNGILEFEEFVRALSVFHPNAPVDDKIDFAFKLYDLKQQGFIEKQEVKQMVVATLAESGMNLSDEVIEGIIDKTFEEADTKHDGKIDKEEWRNLVLRHPSLLKNMTLPYLRDITTTFPSFVFNSQVEDA

SEQ ID NO: 1179 - protein, 161 aa, Zea mays
MAQRDKKEEPTELRAPEIALCANNCGFPGNPATQNLCQSCFSASRSSSSPTSSSSSLASAASQPRPAALVVDAAAVEALAAPAAAAVGQATEAAARASASRCSSCRKRVGLTGFRCRCGELFCGAHRYSDRHGCSYDYRGAARDAIARENPVVRAAKVVRF

SEQ ID NO: 1180 - protein, 161 aa, Zea mays; identical to SEQ ID NO: 178

SEQ ID NO: 1181 - protein, 172 aa, Sorghum bicolor; identical to SEQ ID NO: 826

SEQ ID NO: 1182 - protein, 172 aa, Sorghum bicolor; identical to SEQ ID NO: 827

SEQ ID NO: 1183 - protein, 172 aa, Sorghum bicolor; identical to SEQ ID NO: 827

SEQ ID NO: 1184 - protein, 177 aa, Hordeum vulgare
MADSSAPTRVMMAVNESSLKGYPHPSISCRSAFDWMLSKLVRSNTDGFHLLFLHVQVPDEDGFDDVDSIYASPTDFQSMKQRDKIRGIHLLEYFVNECHRLGIKCEAWTKQGDPKEVICHEVKRVQPDLLVVGSRGLGPFQRVFLGAVSEYCVKHAECPVITIKRKANETPQDPIDD

SEQ ID NO: 1185 - protein, 177 aa, Hordeum vulgare; identical to SEQ ID NO: 1184

SEQ ID NO: 1186 - protein, 177 aa, Zea mays
MADSSAPTRVMMAVNESSLKGYPHPSISCRTAFDWTLSKLVRSNPGGFHFLFVHVHVPDEDGFDDMDSIYASPEDFHQMKQRDKIRGLHLLEYFVNQCHQLGIKCEAWIRHGDPKEVICSEVKRVQPDLLVVGSRGLGPFQRVFVGTVSEFCVKHAECPVITIKRNATEAPQDPVDD

SEQ ID NO: 1187 - protein, 177 aa, Oryza sativa; identical to SEQ ID NO: 180

SEQ ID NO: 1188 - protein, 177 aa, Oryza sativa; identical to SEQ ID NO: 180

SEQ ID NO: 1189 - protein, 177 aa, Sorghum bicolor
MADSSAPTRVMMAVNESSLKGYPHPSISCRTAFDWTLSKLVRSNPGGFHFLFIHVQVPDEDGFDDMDSIYASPEDFHQMKRRDKIRGLHLLEYFVNQCHQLGIKCEAWIRHGDPKEVICSEVKRVQPDLLVVGSRGLGPFQRVFVGTVSEFCVKHAECPVITIKRNATEAPQDPVDD

SEQ ID NO: 1190 - protein, 177 aa, Sorghum bicolor; identical to SEQ ID NO: 1189

SEQ ID NO: 1191 - protein, 99 aa, Saccharum officinarum
MADSPPPTRVMMAVNESSLKVYPHPSISCRTAFDWTLSKLVRFNPGGFHFLFIHGQVPDEDGFDDMDSIYALTMDFHQMKHLYKIRGLHLLEYFVNQCQ

SEQ ID NO: 1192 - protein, 177 aa, Saccharum officinarum
MADSSAPTRVMMAVNESSLKGYPHPSISCRTAFDWTLSKLVRSNPGGFHFLFIHVQVPDEDGFDDMDSIYASPEDFHQMKHRDKIRGLHLLEYFVNQCHQLGIKCEAWIRHGDPKEVICSEVKRVQPDLLVVGSRGLGPFQRVFVGTVSEFCVKHAECPVITIKRNATEAPQDPVDD

SEQ ID NO: 1193 - protein, 177 aa, Triticum sp.
MADSSAPTRVMMAVNESSLKGYPHPSISCRSAFDWMLSKLVRSNTDGFHLLFLHVQVPDEDGFDDMDSIYASPTDFQSMKQRDRIRGIHLLEYFVNECHRLGIKCEAWTKQGDPKEVICHEVKRVQPDLLVVGSRGLGPFQRVFVGTVSEFCVKHAECPVITIKRKANEAPQDPIDD

SEQ ID NO: 1194 - protein, 170 aa, Hordeum vulgare
MAGETGATAASGPAAGKMTMVVGVDESEHSYYALQWTLLHFFSPGQQQYRLVVVTAKPTAASAVGLAGPGAADVLPFVEADLKRSSLRVIDKAKELCAQAQVGDGVFEVVEGDARNVLCEAVERNHAEMLVVGNHGYGAIKRAVLGSVSDYCTHHAHCTVMIVKKPKHKH

SEQ ID NO: 1195 - protein, 170 aa, Hordeum vulgare; identical to SEQ ID NO: 184

SEQ ID NO: 1196 - protein, 166 aa, Zea mays
MTMVVGVDESEHSFYALQWALQHFFPPGQPQQYRLVVVTAKPTAASAVGLAGPGAADVLPYVEADLKRSALRVVEKAIGLCTQASDAVFEALEGDARNVLCEAVERHGAEMLVVGSHGYGAIKRSVPSDLTHSLSYFLFSSPLFPNYRVAAIFIRHWLQRLPLTKF

SEQ ID NO: 1197 - protein, 169 aa, Oryza sativa
MAEEAAAASSAAEGRMTMVVGVDESKHSYYALQWTLRHFFAAAAGQPPQYRLVVVNAKPTAASAVGLAGPGAADVLPFVEADLKKSSMRVIEKARELCAQVSDALFEVLEGDARNVLCESVERHQAEMLVVGSHGYGAIKRAVLGSVSDYCSHHAHCTVMIVKKPKHKH

SEQ ID NO: 1198 - protein, 172 aa, Oryza sativa
MAEEAAAASSAAEGRMTMVVGVDESEHSYYALQWTLRHFFAAAAGQPPQYRLVVVNAKPTAASAVGLAGPGTRGAADVLPFVEADLKKSSMRVIEKARELCAQVSDALFEVLEGDARNVLCESVERHQAEMLVVGSHGYGAIKRAVLGSVSDYCSHHAHCTVMIVKKPKHKH

SEQ ID NO: 1199 - protein, 154 aa, Sorghum bicolor; identical to SEQ ID NO: 185

SEQ ID NO: 1200 - protein, 176 aa, Sorghum bicolor
MAEEAAAPAVAAGTEAAPPPGKMTMVVGVDESEHSFYALQWALQHFFPPPPQPQQYRLVVVTAKPSAASAVGLAGPGAADVLPYVEADLKKTALRVIDKAKALCAQVSDAVFEAVEGDARSVLCEAVERHHAEMLVVGSHGYGAIKRAVLGSVSDYCAHHAHCTVMIVKKPKHHKH

SEQ ID NO: 1201 - protein, 172 aa, Saccharum officinarum
MAEEAASAPATEAAPTGKMTMVVGVDDSDHSFYALQWALQHFFPPAPQPQQYRLVVVTAKPSAASAIGLAGPGAADVLPYVEADLKKTALRVIDKAKALCAQVSDAVFEAVEGDARNVLCEAVERHHADMLVVGSHGYGAIKRAVLGSVSDYCAHHAHCTVMIVKKPKQHKH

SEQ ID NO: 1202 - protein, 167 aa, Saccharum officinarum
MAEEAASAPAAAGRMTMVVGVDDSEHSFYALQWALQHFFPPGQPQQYRLVVVTAKPSAASAIGLAGPGAADVLPYVEADLKKTALRVIDRAKGLCARVSDAVFEAVEGDARSVLCEAVERHHAEMLVVGSHGYGAIKRAVLGSVSDYCAHHAHCTVMIVKKPKQHKH

SEQ ID NO: 1203 - protein, 175 aa, Saccharum officinarum
MAEEAAASAPAAGTEAPPPGKMTMVVGVDDSDHSFYALQWALQHFFPPAPQPQQYRLVVVTAKPSAASAVGLSGPGAADVLPYVEADLKKTALRVIDKAKALCAQVSDAVFEAVEGDARNVLCEAVERHHAEMLVVGSHGYGAIKRAVLGSVSDYCAHHAHCTVMIVKKPKQHKH

SEQ ID NO: 1204 - protein, 164 aa, Saccharum officinarum
MAEEAASAPATEAAPTGKMTMVVGVDDSDHSFYALQWALQHFFPPAPQPQQYRLVVVTAKPSAASAVGLAGPGAADVLPYVEADLKKTALRVIDKAKALCAQVSDAVFEAVEGDARNVLCEAVERHHAEMLVVGSHGYGAIKRAVLGSVSDYCAHHAHCTVMIV

SEQ ID NO: 1205 - protein, 152 aa, Triticum sp.
MTMVVGVDESEHSYYALQWTLLHFFSPGQQQQYRLVVVTAKPTAASAVGLAGPGAADVLPFVEADLKRSSLRVIDKAKELCAHVSDAVFEVVEGDARNVLCEAVERHHAEMLVVGNHGYGAIKRAVLGSVSDYCTHHAHCTVMIVKKPKHKH

SEQ ID NO: 1206 - protein, 169 aa, Triticum sp.
MAEETGATAASGSAAGKMTMVVGVDESEHSYYALQWTLLHFFSPGQQQQYRLVVVTAKPTAASAVGLAGPGAAEVLPFVEADLKRSSLRVIDKAKELCAQVSDAVFEVVEGDARNVLCEAVERHHAEMLVVGNHGYGAIKRAVLGSVSDYCTHHAHCTVMIVKKPKHKH

SEQ ID NO: 1207 - protein, 169 aa, Triticum sp.
MAEETGATAASGSAAGKMTMVVGVDESEHSYYALQWTLLHFFSPGQQQQYRLVVVTAKPTAASAVGLAGPGAADVLPFVEADLKRSSLRVIDKAKELCAQVSDAVFEVVEGDARNVLCEAVERHHAEMLVVGNHGYGAIKRAVLGSVSDYCTHHAHCTVMIVKKPKHKH

SEQ ID NO: 1208 - protein, 172 aa, Triticum sp.
MAEETGATAASGPAAGGEGKMTMVVGVDESEHSYYALQWTLLHFFSPGQQQQYRLVVVTAKPTAASAVGLAGPGAADVLPFVEADLKRSSLRVIDKAKELCAQVSDAVFEVVEGDARNVLCEAVERHHAEMLVVGNHGYGAIKRAVLGSVSDYCTHHAHCTVMVVKKPKHKH

SEQ ID NO: 1209 - protein, 166 aa, Hordeum vulgare
MAAEGERWVGLAVDFSEGSRAALQWAADNLLRSGDNLLLLHVLKDPDYEQGETLLWEASGSPLIPLSEFSHPSVAKKYGVKPDAETLDMLNTIAKQKEVAVVSKVLFGDPREKLCQAIHDMPISCLVIGSRGLGKLKRVLLGSVSDYVVNNAACPVTVVKPASTHA

SEQ ID NO: 1210 - protein, 166 aa, Hordeum vulgare; identical to SEQ ID NO: 1209

SEQ ID NO: 1211 - protein, 167 aa, Zea mays
MASAEGERWVGLATDFSQGSREALQWAATNLLRAGDHLLLLHVIKEPDYEQSEAILWESTGSPLIPLSEFSDPIIAKKYGAKPDMETLDLLNTTATQKEIMVVVKVLWGDPREKLCQVIHDTPLSCLVIGSRGLGKLKRVLLGSVSDYVVNNATCPVTVVKSSSTEG

SEQ ID NO: 1212 - protein, 167 aa, Zea mays; identical to SEQ ID NO: 186

SEQ ID NO: 1213 - protein, 167 aa, Oryza sativa
MAGEAAAAERWVGAAVDFSEGSRAALRWAADNLLRAGDHLILLHVLKDPDYEQGETLLWEATGSPLIPLSDFSEPTIAKKYGAKPDAETLDMLNTVARQKEVVVVFKVLWGDPREKLCQAINEIPMSCLVIGSRGLGKLKRVLLGSVSDYVVNNATCPVTVVKTADG

SEQ ID NO: 1214 - protein, 167 aa, Oryza sativa; identical to SEQ ID NO: 1213

SEQ ID NO: 1215 - protein, 167 aa, Sorghum bicolor
MAGAEGERWVGLATDFSEGSRAALRWAAANLLRAGDHLLLLHVIKEPDYEQSEAILWESTGSPLIPLSEFSDPIIAKKYGAKPDIETLDILNTTATQKEIMVVVKVLWGDPREKLCQVIHDTPLSCLVIGSRGLGKLKRVLLGSVSDYVVNNATCPVTVVKSSSTEG

SEQ ID NO: 1216 - protein, 167 aa, Saccharum officinarum; identical to SEQ ID NO: 1215

SEQ ID NO: 1217 - protein, 166 aa, Triticum sp.
MAADGERWVGLAVDFSEGSRAALQWAADNLLRSGDNLLLLHVLKDPDYEQGETLLWEASGSPLIPLSEFSHPSTAKKYGVKPDAETLDMLNTIAKQKEVSVVSKVLFGDPREKLCQAIHDMPISSLVIGSRGLGKLKRVLLGSVSDYVVNNAACPVTVVKPASNHA

SEQ ID NO: 1218 - protein, 166 aa, Triticum sp.
MAADGERWVGLAVDFSEGSRAALQWAADNLLRAGDNLLLLHVLKDPDYEQGETLLWEASGSPLIPLSEFSHPSTAKKYGVKPDAETLDMLNTIAKQKEVAVVSKVLFGDPREKLCQAIHDMPISSLVIGSRGLGKLKRVLLGSVSDYVVNNAACPVTVVKPASNHA

SEQ ID NO: 1219 - protein, 166 aa, Triticum sp.
MAADGGRWVGLAVDFSEGSRAALQWAADNLLRAGDNLLLLHVLKDPDYEQGETLLWEASGSPLIPLSEFSHPSIAKKYGVKPDAETLDMLNTIAKQKEVAVVSKVLFGDPREKLCQAIHDMPISSLVIGSRGLGKLKRVLLGSVSDYVVNNAACPVTVVKPASNHA

SEQ ID NO: 1220 - protein, 166 aa, Triticum sp.
MAADGERWVGLAVDFSEGSRAALQWAADNLLRAGDNLLLLHVLKDPDYEQGETLLWEASGSPLIPLSEFSHPSTAKKYGVKPDAETLDMLNTIAKQKEVAVVSKVLFGDPREKLCQAIHDMPISCLVIGSRGLGKLKRVLLGSVSDYVVNNAACPVTVVKPASNHA

SEQ ID NO: 1221 - protein, 177 aa, Triticum sp.
  misc_feature (35)..(35): Xaa can be any naturally occurring amino acid
  misc_feature (47)..(47): Xaa can be any naturally occurring amino acid
  misc_feature (156)..(156): Xaa can be any naturally occurring amino acid
  misc_feature (158)..(158): Xaa can be any naturally occurring amino acid
  misc_feature (162)..(162): Xaa can be any naturally occurring amino acid
MAGAEGERWVGLATDSRRGAGASNGFSEGSRAALXWAAANLLRAGDXLLLLHVIKEPDYEQSEAILWESTGSPLIPLSEFSDPIIAKKYGAKPDIETLDILNTTATQKEIMVVVKVLWGDPREKLCQVIHDTPLSCLVIGSRGLGKLKRVLLGSVXDXVVNXATCPVTVVKSSSTEG

SEQ ID NO: 1222 - protein, 294 aa, Zea mays
MKRPTSRGSSMVSGQATTDLQEDSCRSMEPHGVDGDATAAAERDDVDAGAYDEEVDEEEELAGSRGGLGEKKRRLAADQVRALERSFEVDNKLDPERKARIARDLSLHPRQVAVWFQNRRARWKTKQIERDFAALRVRHDALRVECDALRRDKDALAAEIKELRGMVEKQMEVKLESAAEELLPVATRSAAAAAVYNKDGSTDSDSSAVFNEEASPYPYSGAALDHQQQQETSHPLGFTGFTSFLTSSFPSVYHGDSHLDQEADGFFSAAAAGDGFFAEEQSAGIGSWYGGEGW

SEQ ID NO: 1223 - protein, 282 aa, Zea mays
MDWGNRTKAAAAAAAPDERAGGGEGLGGYVKVMTDEQMEVLRKQISIYATICEQLVEMHRVLTEHQDTIAGLRFSNLYCDPLIIPGGHKITARQRWQPTPMQLQILESIFDQGNGTPSKQKIKEITAELSQHGQISETNVYNWFQNRRARSKRKQAAASLPNNAESEAEADEEPLADKKPKSDRPPPPPPPIQDNTKATGALSADRVSGGTRHLDTGHDQTSGVMYGCNDSGLLRSSGSSGQMSLYENFMSNPRIDRFPAKVESSRSFPHLQQHGEGFGMFG

SEQ ID NO: 1224 - protein, 255 aa, Zea mays
MEWVDRTKASAAAAAAAADERAGGAEGLAGYVKVMTDEQMEVLRKQISIYATICEQLVEMHRALTEHQDTIAGSGIRFSNLYCDPQIIPGGHKITARQRWQPTPMQLQILENIFDQGNGTPSKQRIKEITAELSHHGQISETNVYNWFQNRRARSKRKQAASLPNNAESEAEVDEESLTDKKPKSDRSLQDNKAMGAHNADRISGMHHLDTDHDQIGGMMYGCNDNGLRSSGSSGQMSFYGNIMPNPRIDHFPGK

SEQ ID NO: 1225 - protein, 273 aa, Zea mays; identical to SEQ ID NO: 188

SEQ ID NO: 1226 - protein, 255 aa, Zea mays; identical to SEQ ID NO: 1224

SEQ ID NO: 1227 - protein, 184 aa, Saccharum officinarum
  misc_feature (157)..(157): Xaa can be any naturally occurring amino acid
MEWGDRAKASAAAVAADERAGGGEVLGGYVKVMTDEQMEVLRKQISIYATICEQLVDMHRTLTEHQDTIAGMRFSNLYSDPLIIPGGHKITARQRWQPTPMQLQILENIFDQGNGTPSKQKIKEITAELSHHGQISETNVYNWVQNRRARSKRKQAXSLPNTSNAESEAEVDEESLTDKKPKVR

SEQ ID NO: 1228 - protein, 757 aa, Hordeum vulgare; identical to SEQ ID NO: 191

SEQ ID NO: 1229 - protein, 764 aa, Zea mays
  misc_feature (402)..(402): Xaa can be any naturally occurring amino acid
MTVTPRITVWDGRLVAHGRSVLAGVPDNIVLTHASGAGLVDGAFVGATAAEPSSMHVFTFGTLRDLRFVCCFRFKLWWMTQRMGTSGRDVPLETQFMLLECGPGDGHGDGDAAVYVAMLPLLEGQFRAALQGNDRDELEITLESGDKAVQTAQGTCMLYVHAGTNPFDTITQAVKVVERHMQTFHHREKKKLPSFVDWFGWCTWDAFYTDVTAESVKQGLKSLADGGTPPRFLIIDDGWQQIGSENKEESANAVVQEGAQFASRLTGIKENAKFQKKTKTKESGGGGGEQQAQTPGLKLLVEEAKREHGVRYVYVWHAMAGYWGGVKPAAEGMEHYESALAYPVQSPGVMGNQPDIVMDSLSVLGLGLVHPRRALSFYDELHSYLASCGVDGVKVDVQNIIXTLGAGHGGRVALTRAYHRALEDSVARNFPDNGCISCMCHNTDMLYSARQTAVVRASDDFYPRDPASHTVHVSSVAYNTLFLGEFMQPDWDMFHSLHPAADYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSVRADDVDVIAGLAGDGWGGEAVVYAYRSGELVRLPQGATLPVTLKVLEFEVFHVSPVRAVAPGVSFAPIGLLDMFNSGGAVEQCEVRGGANGGAGAVVALRVRGCGRFGAYCSRRPARCRLDAAEVDFSYDDDTGLVALHIPVPEQEFYRWDLEIDV

SEQ ID NO: 1230 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKHGLQSLSKGGAPPRFLIIDDGWQQIASENKPDPNVAVQEGAQFASRLTGIKENTKFQTKPDGDGDGEQAPGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVARSFPDNGCISCMCHNSDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVAGDGGGWDGETVVYAHRTRELVRLPRGVALPVTLGPLQYEVFHVCPLRAVVPGVSFAPVGLLDMFNAGGAVEECDVISDDGGKAMALRVRGCGRFGAYCSREPARCLLDSAEVEFSYDIDTGLVSVDLLVPEQELYLWTLEIMI

SEQ ID NO: 1231 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKHGLQSLSKGGAPPRFLIIDDGWQQIASENKPDPNVAVQEGAQFASRLTGIKENTKFQTKPDGDGDGEQAPGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVAHSFPDNGCISCMCHNSDMLYSAKQTAVVRAADDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVAGDGGGWDGETVVYAHRTRELVRLPRGVALPVTLGPLQYEVFHVCPLRAVVPGVSFAPVGLLDMFNAGGAVEECDVISDAGGKAMALRVRGCGRFGAYCSREPARCLLDSAEVEFSYDIDTGLVSVDLLVPEQELYLWTLEIMI

SEQ ID NO: 1232 - protein, 803 aa, Oryza sativa
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHVYASVAIAAQSTALFLNQDDDDGGGGDVMNLQSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELIRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 1233 - protein, 803 aa, Oryza sativa
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHVYRFVAIAAQSTALFLNQDDDDGGGGDVMNLQSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELIRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 1234 - protein, 771 aa, Oryza sativa
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHSLHPAAEYHGAARAIGGCPIYVSDKPGNHNFELLKKLVLPDGSVLRARLPGRPTRDCLFVDPARDGASLLKIWNVNKCTGVVGVFNCQGAGWCRITKKTRVHDAAPGTLTGSVRADDVDAIADVAGTGWTGDAVVYAHRSGELIRLPKGATLPVTLKVLEFELFHVCPVMTVAPGGGGGGVTFAPIGLLDMFNSGGAVEECDVVRALDAAGEAEAEAEAAVVRLRARGCGRFGAYSSRRPARCALDAVEVEFSYDADTGLVALDVPVPAHELYKWTVEIQV

SEQ ID NO: 1235 - protein, 763 aa, Oryza sativa
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGVRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNNCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 1236 - protein, 763 aa, Oryza sativa; identical to SEQ ID NO: 1235

SEQ ID NO: 1237 - protein, 764 aa, Sorghum bicolor; identical to SEQ ID NO: 192

SEQ ID NO: 1238 - protein, 764 aa, Sorghum bicolor; identical to SEQ ID NO: 192

SEQ ID NO: 1239 - protein, 752 aa, Triticum sp.
MTVTPQITVSDGRLAVRGRTVLSGVPDNVTAAHASGAGLVDGAFVGATAGEAKSHHVFTFGTLRDCRFMCLFRFKLWWMTQRMGTSGRDVPLETQFILIEVPAAAGNDDGDSEPVYLVMLPLLEGQFRTVLQGNDQDQLQICIESGDKAVQTEQGMNSVYIHAGTNPFDTITQAVKAVEKHMQTFHHREKKKVPSFVDWFGWCTWDAFYTDVTADGVKQGLRSLAEGGAPPRFLIIDDGWQQIGSENKEDPSVAVQEGAQFASRLTGIKENTKFQSEHEQEETPGLKRLVEETKKEHGVKSVYVWHAMAGYWGGVKPSAAGMEHYESALAYPVQSPGVTGNQPDIVMDSLSVLGLGLVHPRKVYNFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMNKCAGVVGVFNCQGAGWCRVVKKTRIHDEAPGTLTGSVRAEDVEGITQATGTDDCTGDAVVYTHRAGELVRLPRGATLPVTLKRLEYELFHVCPVRAVAPDISFAPIGLLHMFNAGGAVEECVVRTNEDDKAVVALRVRGCGRFGAYCSRRPAKCSLDSADVEFGYDADTGLVTVDVPVPEEEMYRWTLEIRV

SEQ ID NO: 1240 - protein, 752 aa, Triticum sp.
MTVTPQITVSDGRLAVRGRTVLSGVPDNVTAAHASGAGLVDGAFVGATAGEAKSHHVFTFGTLRDCRFMCLFRFKLWWMTQRMGTSGRDVPLETQFILIEVPAAAGNDDGDSEPVYLVMLPLLEGQFRTVLQGNDQDQLQICIESGDKAVQTEQGMNSVYIHAGTNPFDTITQAVKAVEKHMQTFHHREKKKVPSFVDWFGWCTWDAFYTDVTADGVKQGLRSLAEGGVPPRFLIIDDGWQQIGSENKEDPSVAVQEGAQFASRLTGIKENTKFQSEHDQDDTPGLKRLVEETKKEHGVKSVYVWHAMAGYWGGVKPSAAGMEHYESALAYPVQSPGVTGNQPDIVMDSLSVLGLGLVHPRKVYNFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMNKCAGVVGVFNCQGAGWCRVVKKTRIHDEAPGTLTGSVRAEDVEGIAQAAGTDDCTGDAVVYAHRAGELVRLPRGATLPVTLKRLEYELFHVCPIRTVAPDVSFAPIGLLHMFNAGGAVEECTVRTDEDDKAVVALRVRGCGRFGAYCSRRPVKCSLDSADVEFGYDADTGLVTVDVPVPEKEMYRWTLEIRV

SEQ ID NO: 1241 - protein, 543 aa, Zea mays
MAPEKPRKEQEEEEDELMLEDGGIEESPRRSFEDCGDSDEEDDDNDEERDGDGVGSPRSFQSHKWPQSYRETTDTYTIAASPSFGYLGPSTSKYSLLDLGRSGLGSDLKLPLVSDKADGKQDSVKTLPKTLGSIRDERVSFQLQHTGELYITQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTTIFPKAGVDWFGIHVDGKHFFGVLTAILVLPTVWLRDLRVLSYLSAGGVIATLLVFLSVGLVGATDGIGFHSTGKVVNWSGMPFAIGIYGFCYSGHSVFPNIYQSMSDRSKFPKALFICFAICTAIYGSFAVIGFLMFGENTLSQITLNLPKHSIASKVALWTTVINPFTKYALLLNPLARSLEELRPEGFLNETSCSIILRTALVASTVCIAFLLPFFGLVMALIGSLLSILVAVIMPALCFLKIAQNKATCAQVIASICIVMLGVISAALGTYSSVKKIVENY

SEQ ID NO: 1242 - protein, 544 aa, Zea mays
  misc_feature (114)..(114): Xaa can be any naturally occurring amino acid
  misc_feature (260)..(260): Xaa can be any naturally occurring amino acid
  misc_feature (270)..(270): Xaa can be any naturally occurring amino acid
MAPEKPRKEQEEELMLEDGGIEESPRRSFEDCGDSEEDRGEGDDEEERDSDRDGVGSTRSFLPQKWPQSYRETTDTYTIAASPSFGYLGPSTSKYSLLDLGRSGLGSDLKLPLXSDKADGKQDSVKTLPKTLGSIRDERVSFQLQHTGELYITQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTXIFPKAGFDWXGIHVDGKHFFGVLTAILVLPTVWLRDLRVLSYLSAGGVIATLLVFLSVGLVGATDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPALCFLKIAQNKATCPQVIASVGIVILGVVSAALGTYSSVKKIAENY

SEQ ID NO: 1243 - protein, 540 aa, Zea mays
MAPEKPRKEQEEELMLEDGGIEESPRRSFEDCGDSEEDRGEGDDEEERDSDRDGVGSTRSFLPQKWPQSYRETTDTYTIAASPSFGYLGSSTSKYSLLDLGRSILGSDLKSPLISAKADSVRNLPKTLGSMRDGRVSFQLQHTGEIYISQGCNVTQTVFNGINVLAGVGLLSTPFTIHEAGWTGLAVLACFAIVCCYTGILLKHCFESKDGISSYPDIGEAAFGRIGRVLISIILYTELYSYCVEFIILEGDNLTSIFPKAGFDWLGIHVDGKHFFGVLTAILVLPTVWLRDLRVLSYLSAGGVIATLLVFLSVGLVGVTDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGTYSSVKKIVENY

SEQ ID NO: 1244 - protein, 323 aa, Oryza sativa
MAAAAAAAEAKHRKEEEEDEEEMTLEDGDIEESPRRSFDDDYEDGGSGDDDRDDDGEGLGSPRSFQSRQWPQSYRETTDTYTIAASPSFGYLGPSTSKYSILDGGRSSLGSDLKLPLLSDKLDGKQDSVKSLRKTLGSAIDRKSSLLTQHTGEVYIAQGCSVTQTVFNGVNVLAGVGLLSTPFTIHEAGWVGLAVLAMFAIVCCYTGVLMKHCFESKDGISTYPDIGEAAFGRIGRLLISIILYTELYSYCVEFIILEGDNMTSIFSHIGFDWLGVHIDGKHFFGVLTALIVLPTVWLRDLRVLSYLSGLNTLNLKYFSHCDH

SEQ ID NO: 1245 - protein, 323 aa, Oryza sativa; identical to SEQ ID NO: 1244

SEQ ID NO: 1246 - protein, 530 aa, Triticum sp.
  misc_feature (152)..(152): Xaa can be any naturally occurring amino acid
MAAAAARQRKEEEDEMLLDDGDIEESPRDSFRDSDDEGEEEGRGEDGDGVGSFESHQWPQSYRETTDTYTIAASPIFGYLGPSTSKYSIDGGRSGLASDLRLPFISDKLESVKSLRRHLLGSVRDEKLSFQYTGEIYVGQGCSVTQTVFNGXNVLAGVGLLSAPFTIHEAGWAGLAVLSVFAIICCYTGVLLKHCFESKDGIATYPDIGEAAFGRIGRLIISIILYTELYSYCVEFIILEGDNMTSIFPDVNINLFGIHVDSKHFFGVLTALVVLPTVWLRDLRVLSYLSAGGVIATLVVFISVALVGTTEGVGFHQTGEAVKWSGMPFAIGIYGFCYSGHSVFPNIYQSMSDRTKFPKALFICFVVCTAIYGSFAIIGYLMFGDKTLSQITLNLPKESFASKVALWTTVINPFTKFALLLNPLARSLEELRPEGFLNETIVSIILRTSLVASTVVIAFLLPFFGLVMALIGSLLSILVAVIMPALCFLKITQNKATRPQVIASVAIIVVGVISAALGTYSSVASIIGYY

SEQ ID NO: 1247 - protein, 530 aa, Triticum sp.
MAAAAARQRKEEEDEMLLDDGDIEESPRDSFRDSDDEGEEEGRGEDGDGVGSFESHQWPQSYRETTDTYTIAASPIFGYLGPSTSKYSIDGGRSGLASDLRLPFISDKLESVKSLRRHLLGSVRDEKLSFQYTGEIYVGQGCSVTQTVFNGVNVLAGVGLLSAPFTIHEAGWAGLAVLSVFAIICCYTGVLLKHCFESKDGIATYPDIGEAAFGRIGRLIISIILYTELYSYCVEFIILEGDNMTSIFPDVNINLFGIHVDSKHFFGVLTALVVLPTVWLRDLRVLSYLSAGGVIATLVVFISVALVGTTEGVGFHQTGEAVKWSGMPFAIGIYGFCYSGHSVFPNIYQSMSDRTKFPKALFICFVVCTAIYGSFAIIGYLMFGDKTLSQITLNLPKESFASKVALWTTVINPFTKFALLLNPLARSLEELRPEGFLNETIVSIILRTSLVASTVVIAFLLPFFGLVMALIGSLLSILVAVIMPALCFLKIAQNKATRPQVIASVAIIVVGVISAALGTYSSVASIIGYY

SEQ ID NO: 1248 - protein, 373 aa, Zea mays
MLEEYKPCAAMVVTQCIYAALALLSKAAFTGGMSPLVFVVYRQAVATIVLVPVVIAANRKKMKEMTTGLGLTGFSLVFVASLVGATVNQCMYYQGVNLGSSSMATAMTNLIPAITFVMAASVGLERVEARRPRSLAKIFGTAVCVSGAMAMAFFKGPKLLGDGPNALQLLLHAGGGGRWVAGALFLVGSSSCWSLWLILQVPICKSYVEPLALSAWMCVLSTLQSALLVSFLLPDPSAWRIHSLFELSCCVFSGVFGSGVTFYLQSWCISVRGPLYSAMFNPLCTVITTVFAAAVLREELHVGSLLGAIAVIAGLYVVLWGKAGDANKGGVEPEHHSDDLEKTSSARSDPNSTAGVGSGIAEPLLAGGDPTEK

SEQ ID NO: 1249 - protein, 238 aa, Saccharum officinarum
MEEYKPCAAMVVTQCIYAALALWSKAVFTGGMSPLVFVVYRQAVATIVLVPVVIAANRRKMKEMMGRLGITGFSLVFVASLVGATVNQCLYYQGVNLGSSSMATAMTNLIPAITFVMAASVGLERVDVRRPRSLAKIFGTAVCVSGAMAMAFFKGPKLLLCDLHALLLLHSPAAAGGRWVTGALFLVGSSSCWSLWLILQVPICKSYVDPLALSAWMCLLSTLQSALLVAFLLPDPTA

SEQ ID NO: 1250 - protein, 332 aa, Saccharum officinarum
MEEYKPCAAMVVTQCIYAALALWSKAVFTGGMSPLVFVVYRQAVATIVLVPVVIAANRRKMKEMMGRLGITGFSLVFVASLVGATVNQCLYYQGVNLGSSSMATAMTNLIPAITFVMAASVGLERVDVRRPRSLAKIFGTAVCVSGAMAMAFFKGPKLLLCDLHALLLLHSPAAAGGRWVTGALFLVGSSSCWSLWLILQVPICKSYVDPLALSAWMCLLSTLQSALLVAFLLPDPTAWRIHSLFDLSCCLFSGVFGSGVTFYLQSWSISVRGPLYSAMFNPLCTVITTVFAAAVLREELHVGRFVIVMHARFISYGDRAWSCESVTSIFCG

SEQ ID NO: 1251 - protein, 327 aa, Hordeum vulgare
MGIGDGSPSETQHAAHKEKRDETTPLLPLKAEEEDGIHEFNGASFSGAVFNLSTTIVGAGIMALPASIKMLGIIPGILMIILVALLTEASIDMMVRCSHQAKITSYGWLMGDSFGQWGRIALQASVVINNIGVMIVYMIIIGDVLSGTSTTGVHHRGIFEGWFGPHLWNSRPVVLLATTIFVFAPLVSFKRLDSLRYTSALSVALAVVFVVITAGIAILRLIEGTAEIPKLFPEIHEINSIWELFTAVPVLVTAYICHYNVHSIDNELEDRSQTKPIVRTSLALCSKCLCCHKFLCISPLLARLPSPMCSLILTPTFIFHSALSSMI

SEQ ID NO: 1252 - protein, 327 aa, Hordeum vulgare
  misc_feature (287)..(287): Xaa can be any naturally occurring amino acid
MGIGDGSPSETQHAAHKEKRDETTPLLPLKAEEEDGIHEFNGASFSGAVFNLSTTIVGAGIMALPASIKMLGIIPGILMIILVALLTEASIDMMVRCSHQAKITSYGWLMGDSFGQWGRIALQASVVINNIGVMIVYMIIIGDVLSGTSTTGVHHRGIFEGWFGPHLWNSRPVVLLATTIFVFAPLVSFKRLDSLRYTSALSVALAVVFVVITAGIAILRLIEGTAEIPKLFPEIHEINSIWELFTAVPVLVTAYICHYNVHSIDNELEDRSQTKPIVRTSLALCSXCLCCHKFLCISPLLARLPSPMCSLILTPTFIFHSALSSMI

SEQ ID NO: 1253 - protein, 262 aa, Hordeum vulgare
  misc_feature (64)..(64): Xaa can be any naturally occurring amino acid
  misc_feature (113)..(114): Xaa can be any naturally occurring amino acid
MGVGNGSADVSQQMSRNEIRDETTPLLPVKVEEEGFHEFNGASFSGAVFNLSTTIVGAGIMALXASIKMLGLIPGLLMIVFVALLTEASIDMLIRCSHQGKITSYGWLMGEGXXGRIALQASVVINNIGVMIVYMIIIGDVLSGTSSGGVHHRGILEGWFGAHLWNSRAIVLLVTTLFVFAPLVSFKRLDSLSYTSALSVALAVIFVVITAGIAIIKVFNGTVAMPKLFPEIDSLSSVWKLFTAVPVLVTAYICHYNVLFPS

SEQ ID NO: 1254 - protein, 416 aa, Zea mays
MGIGDGSSNGNQQPVHKEIRDETTPLLPVKVEEDEGFHEFNGASFSGAVFNLSTTIVGAGIMALPASIKMLGIIPGILLIILVALLTEASIDMLVRCSHQGKITSYGWLMGEVFGQWGRIALQASVIINNVGVLIVYMIIIGDVLSGTTSGDVHHRGILEGWFGAHLWNSRAIVLLATALLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITVSLLAVIYLAAILIPSIWDAFQFTGATAAVLIGFIFPAMVILR

SEQ ID NO: 1255 - protein, 459 aa, Oryza sativa
MGIGNGSPSDSRHVSHKEIRDETTPLLPIKEEEEGIHEFNGASFSGAVFNLSTTIVGAGIMALPASIKMLGIIPGILMIILVALLTEASIDMLVRCSHEGKITSYGWLMGETFGQWGRIALQASVVINNIGMMIVYMIIVGDVLSGTSTSGVHHRGIFEGWFGPHLWNSRPVVLLATTLFVFGPLVSFKRLDSLRYTSALSVALAVVFVVITAGIAIVRLIEGTVEIPKLFPELDGTNSIWELFTAVPVVVTAYICHYNVHSIDNELEDRTQTKPIVQTSLALCSSVYIATSFFAYLLFGEGTLADVLANFDSNLHIPFSSVFNDVVRVSYVVHIMLVFPIVFFALRLNLDGLLFPTARHISRDNRRFAIITGSLLAVIYLAAIFIPSIWDAFQFTGATAAVLIGFIFPAMIILRDPYGIATKRDKILALTMIVLAVLSNSVALYSDALNIIFHRKVEA

SEQ ID NO: 1256 - protein, 459 aa, Oryza sativa; identical to SEQ ID NO: 1255

SEQ ID NO: 1257 - protein, 458 aa, Oryza sativa
MGISSESPNGSQQIVQKETRDETTPLLPVKVEEEGFHEFNGASFSGAVFNLSTTIVGAGIMALPASIKMLGIIPGILMIIVVALLTEASIDMLVRCSHQGKITSYGWLMGEAYGQWGRIALQASVVINNIGVMIVYMIIIGDVLSGTSSTGVHHRGILEGWFGAHLWNSRAIVLLATTLFVFAPLVSFKRLDSLRYTSALSVALAVVFVVITAGIAIIKLFNGTVAMPKLFPELDGLSSIWKLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITISLLTVIYLAAIFIPSIWDAFQFTGATAAVLIGFIFPAMVILRDPYGIASKCDKILAVTMIVLAVLSNSVALYSDAMNIFRKEEEA

SEQ ID NO: 1258 - protein, 458 aa, Oryza sativa
MGISSESPNGSQQIVQKETRDETTPLLPVKVEEEGFHEFNGASFSGAVFNLSTTIVGAGIMALPASIKMLGIIPGILMIIVVALLTEASIDMLVRCSHQGKITSYGWLMGEAYGQWGRIALQASVVINNIGVMIVYMIIIGDVLSGTSSTGVHHRGILEGWFGAHLWNSRAIVLLATTLFVFAPLVSFKRLDSLRYTSALSVALAVVFVVITAGIAIIKLFNGTVAMPKLFPELDGLSSIWKLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITISLLTVIYLAAIFIPSIWDAFQFTGATAAVLIGFIFPAMVILRDPYGIASKRDKILAVTMIVLAVLSNSVALYSDAMNIFRKEEEA

SEQ ID NO: 1259 - protein, 455 aa, Sorghum bicolor; identical to SEQ ID NO: 197

SEQ ID NO: 1260 - protein, 455 aa, Sorghum bicolor; identical to SEQ ID NO: 197

SEQ ID NO: 1261 - protein, 455 aa, Saccharum officinarum
MGIGNGSSSNVSHKAMQDETTPLLPIKAEEDAVHEFNGASFSGAVFNLSTTIVGAGIMALPASIKMLGLIPGILMIILVALLTEASIDMLVRCSHQGKITSYGWLMGDTFGQWGRIALQGSVVINNVGVLIVYMIIIGDVLSGTSSTGVHHSGVFEGWFGPHMWNSRPIVLLATTLLVFAPLVSFKRLDSLRYTSALSVALAVVFVVITAGVAIVRLIQGTVEIPKLFPEIDGVSSIWKLFTAVPVLVTAYICHYNVHSIDNELEDKTQIKPIVQTSLGLCSSVYIATSFFAYLLFGEATLADVLANFDSDLRIPFSSVFNDIVRVSYVVHIMLVFPIVFFALRLNLDGLLFPTARHISHDNKRFTIITISLVAVIYLAAIFIPSIWDAFQFTGATAAVLIGFIFPAMIILRDPYGVSTKRDKVLAVTMIVLAVVSNSVALYSDALSIFYRKQDA

SEQ ID NO: 1262 - protein, 459 aa, Saccharum officinarum
MGIGDGSSNGNQQPVHKEIRDETTPLLPVKVEEDEGFHEFNGASFSGAVFNLSTTIVGAGIMALPASIKMLGIIPGILLIIIVALLTEASIDMLVRCSHQGKITSYGWLMGEVFGQWGRIALQGSVIINNVGVLIVYMIIIGDVLSGTTSGDVHHRGILEGWFGAHLWNSRPIVLLATALLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLFLCSSVYITTSFFAYLLFGEGTLDDVLANFDANLGIPFSSVFDDIVRVSYAAHVMLVFPIVFFALRLNLDGLLFPTSRHISRDNKRFAIITISLLTVIYLAAILIPSIWDAFQFTGATAAVLIGFIFPAMVILRDSYGIATKRDKILAVTMIVLAVLSNSVALYSDAMNIFCKKEVA

SEQ ID NO: 1263 - protein, 458 aa, Triticum sp.
  misc_feature (28)..(28): Xaa can be any naturally occurring amino acid
MGIGDASPSENQSAHKEKRDETTPLLPXKAEEEDGIHEFNGASFSGAVFNLSTTIVGAGIMALPASIKMLGIIPGILMIILVALLTEASIDMMVRCSHQAKITSYGWLMGDSFGQWGRIALQASVVINNIGVMIVYMIIIGDVLSGTSTTGVHHRGIFEGWFGPHLWNSRPVVLLATTIFVFAPLVSFKRLDSLRYTSALSVALAVVFVVITAGIAILRLIEGTAEIPKLFPEIHEINSIWELFTAVPVLVTAYICHYNVHSIDNELEDRSQTKPIVRTSLALCSSVYVATSFFAYLLFGEGTLSDVLANFDSDLHIPFSSVFNDIVRVSYVVHVMLVFPIVFFALRLNLDGLLFPTSRHISHDNRRFIIITVSLLAVIYLAANFIPSIWDAFQFTGATAAVLIGFIFPAMIILRDSYGIATKRDKVLAVTMIVLAVLSNSVALYSDAMSIFYRKVEA

SEQ ID NO: 1264 - protein, 458 aa, Triticum sp.
MGVGNGSADVNQQTARNEIRDETTPLLPVKVEEEGFHEFNGASFSGAVFNLSTTIVGAGIMALPASIKMLGLIPGLLMIIFVALLTEASIDMLIRCSHQGKITSYGWLMGEAYGQWGRIALQASVVINNIGVMIVYMIIIGDVLSGTSSGGIHHRGILEGWFGAHLWNSRAIVLLVTTLFVFAPLVSFKRLDSLSYTSALSVALAVVFVVITAGIAIIKVINGTVAMPKLFPEIDDLSSVWKLFTAVPVLVTAYICHYNVHSIDNELEDKTQTKPIVRTSLALCSSVYIATSFFAYLLFGDGTLDDVLANFDSNLGIPFSSVFNDVVRVSYAAHVMLVFPIVFFALRLNLDGLLFPTSRHISYDNKRFTIITISLLVVIYTAAIFIPSIWDAFQFTGATAAVLIGFIFPAMVILRDPYGIATKRDKILAVTMIVLAVVSNSVALYSDAMNIFRRKEVA

SEQ ID NO: 1265 - protein, 421 aa, Hordeum vulgare
MGLGSDASSSSSRLDSAPLLPHHSAEGGHLSSQPKTFANVFIAVVGAGVLGLPYTFSRTGWAAGSILLLSVALLTFYCMMLLVACRRRLADEHPKKLSSFGDLGDAVFGAPGRLAVDTMLVLSQASFCVGYLIFISNTMAHLYPIFAPSSNVFLSPKALFIYAMLPFQLGLNSIKTLTLLAPLSIFADVVDLGAMGVVVGQDVSTWLAAHPPVVAFGAPAALLYGVGVSVYAFEGVCMVLPLEAEAADKKKFGATLGLSMAFIAAMYGLFGVMGYVAFGDATRDIITTNLGSGWLSAAVQLGLCINLFFTMPVMMNPVYEVAERLFHGKRYCWWLRCVLVVTVGLAAMLVPNFTDFLALVGSSVCVLLGFVLPATFHMKVFGAEMGWAGVLSDVLLVVLGLVLSVFGTYSSLVQIFHSSSA

SEQ ID NO: 1266 - protein, 421 aa, Hordeum vulgare; identical to SEQ ID NO: 1265

SEQ ID NO: 1267 - protein, 432 aa, Zea mays
MGFGMGNNNNGASSSSSRLDPAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFAVDVMLVLSQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 1268 - protein, 432 aa, Zea mays; identical to SEQ ID NO: 1267

SEQ ID NO: 1269 - protein, 512 aa, Oryza sativa
MENYVSPSKKKKKKKSDPPSRGGREHQHSRIPSYLREISGFVSVFCESRPEKRRGNPVNRGVGVPSLGVVLVVLNFDCFVLFVWGRAVVAMGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASFGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAKRLLHGKRYCWWLRWLLVLAVGLSAMYVPNFTDFLALVGSSVCVLLGFVLPASFHLKVFGAEMSWSGVLSDVLLVLLGLSLAVFGTYTSLLQIFHSSSA

SEQ ID NO: 1270 - protein, 422 aa, Oryza sativa
MGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASFGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAERLLHGKRYCWWLRWLLVLAVGLSAMYVPNFTDFLALVGSSVCVLLGFVLPASFHLKVFGAEMSWSGVLSDVLLVLLGLSLAVFGTYTSLLQIFHSSSA

SEQ ID NO: 1271 - protein, 422 aa, Oryza sativa; identical to SEQ ID NO: 1270

SEQ ID NO: 1272 - protein, 426 aa, Sorghum bicolor
  misc_feature (241)..(241): Xaa can be any naturally occurring amino acid
MGFGMGNNNGASSSSSRLDPAPLLPHHGSGSREVGLSSQPKTFANVFIAVVGAGVLGLPYTFSHTGWAAGTLLLFSVAAVTFYCMMLLVACRRRLADEHPKIASFGDLGDAVFGAHGRFAVDVMLVLSQVSFCVGYLIFISNTMAHLYPITAPSSSALLSPKALFIWAMLPFQLGLNSIKTLTLLAPLSIFADVVDLGAMGVVLGQDASIWLANKPPVFAFAGPAELLYGLGVAVYAFEGXGMVLPLEAEAADKRRFGATLALSMAFIAVMYGLFGVMGYVAFGDATRDIITTNLGAGWLSAAVQLGLCINLFFTMPVMMNPVYEVAERLLHGKRYCWWLRWLLVIVVGLAAMYVPNFTDFLALVGSSVCVLLGFVLPASFHLKVFGGEMEWPGVVSDVLLVVIGLLLAVFGTYTSLLQIFHSSSA

SEQ ID NO: 1273 - protein, 246 aa, Saccharum officinarum
  misc_feature (152)..(152): Xaa can be any naturally occurring amino acid
  misc_feature (154)..(154): Xaa can be any naturally occurring amino acid
  misc_feature (188)..(188): Xaa can be any naturally occurring amino acid
  misc_feature (222)..(222): Xaa can be any naturally occurring amino acid
MGFGMGNNNGASSSSSRLDPAPLLPRHGSGSREAGLSSQPKTFANVFIAVVGAGVLGLPYTFSHTGWAAGTLLLFSVAALTFYCMMLLVACRRRLADEHPKIASFGDLGDAVFGAHGRFAVDVMLVLSQVSFCVGYLIFISNTMAHLYPITXPXSSALLSPKALVIWAMLPFQLGLNSIKTLTLLAPXSIFADVVDLGAMGVVVGQDVAAWLAKPVPVVAYXGPAGFLWAWGFRFTLQGPRNGAFP

SEQ ID NO: 1274 - protein, 421 aa, Triticum sp.
MGLGSDASSSSSRLDSAPLLPHHSAEGGHLSSQPKTFANVFIAVVGAGVLGLPYTFSRTGWAAGSILLLSVALLTFYCMMLLVACRRRLADDHPKMLSSFGDLGDAVFGAPGRLAVDTMLVLSQASFCVGYLIFISNTMAHLYPVFAPSSNVFLSPKALFIYAMLPFQLGLNSIKTLTLLAPLSIFADVVDLGAMGVVVGQDVSTWLAAHPPVAAFGAPAALLYGAGVSVYAFEGVCMVLPLEAEAADKKKFGATLGLSMAFIAVMYGLFGVMGYVAFGDATRDIITTNLGSGWLSAAVQLGLCINLFFTMPVMMNPVYEVAERLFHGKRYCWWMRWVLVVTVGLAAMLVPNFTDFLSLVGSSVCVLLGFVLPATFHIKVFGAEMGWVGVLSDVLLVVLGLVLAVFGTYSSLVQIFHSSSA

SEQ ID NO: 1275 - protein, 373 aa, Hordeum vulgare
  misc_feature (46)..(46): Xaa can be any naturally occurring amino acid
  misc_feature (50)..(51): Xaa can be any naturally occurring amino acid
MEAVESYLGSRQVWFCGLCQYVNLVGTAFGYTITASISAAALYKAXCFHXXGHSADCGVYTTMYMVVFGISQIVFSQLPNLHEMAWLSMLAAVMSFSYSTIGVGLSLAQTIKGPTGKTTIGGTQIGVDVTSAQKIWLTLQALGNIAFAYSYSMVLIEIQDTVKAPPAENKTMRKANLMGVSTTTAFYMLCGCLGYSAFGNDAPGNMLTGFGFYEPFWLIDFANVCIVVHLVGAYQVYCQPIYAAVESWAAGRWPNSEFVVRQYHPFSGTFSLNMFRLVWRTAFVIVSTVLAISLPFFNDILGLLGALGFWPLTVYFPVEMYISQSKMKKYSRKWVALQTLSFACFAVTVAVTVASIQGITQSLKNYVPFKTKL

SEQ ID NO: 1276 - protein, 338 aa, Zea mays
MAMSRAVHKANCFHNKGHAADCSTYDTMYMVVFGIVQIFFSQLPNFSDLSWLSIVAAIMSFSYSSIAVGLSLARTISGRSGTTTLTGTEIGVDVDSAQKVWLALQALGNIAFAYSYSMILIEIQDTVKSPPAENKTMKKATLMGVTTTTAFYMLAGCLGYSAFGNAAPGNILTGFGFYEPYWLIDFANVCIVVHLVGAYQVFSQPIFAALETAAAKRWPNARFVTREHPLVAGRFHVNLLRLTWRTAFVVVSTVLAIVLPFFNDILGFLGAIGFWPLTVYYPVEMYIRQRRIQKYTSRWVALQLLSFLCFLVSLASAVASIEGVTESLKHYVPFKTKS

SEQ ID NO: 1277 - protein, 486 aa, Zea mays
MTQQDVEMAARHGTGADGAGFYPQPRNGAGGETLDDDGKKKRTGTVWTASAHIITAVIGSGVLSLAWSTAQLGWVVGPLTLMIFALITYYTSSLLADCYRSGDQLTGKRNYTYMDAVAAYLGRWQVLSCGVFQYVNLVGTAVGYTITASISAAAVHKANCFHNKGHAADCSTYDTMYMVVFGIVQIFFSQLPNFSDLSWLSIVAAIMSFSYSSIAVGLSLARTISGRSGTTTLTGTEIGVDVDSAQKVWLALQALGNIAFAYSYSMILIEIQDTVKSPPAENKTMKKATLMGVTTTTAFYMLAGCLGYSAFGNAAPGNILTGFGFYEPYWLIDFANVCIVVHLVGAYQVFSQPIFAALETAAAQALAEARFVTREHPLVAGRFHVNLLRLTWRTAFVVVSTVLAIVLPFFNDILGFLGAIGFWPLTVYYPVEMYIRQRRIQKYTSRWVALQLLSFLCFLVSLASAVASIEGVTESLKHYVPFKTKS

SEQ ID NO: 1278 - protein, 487 aa, Oryza sativa
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 1279 - protein, 487 aa, Oryza sativa
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGGVDTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 1280 - protein, 492 aa, Triticum sp.
  misc_feature (283)..(283): Xaa can be any naturally occurring amino acid
MTKDVEMAARNGGNGAVAGEAYYPSPPAQGGDADVDDDGKQRRTGTVWTASAHIITAVIGSGVLSLAWATAQLGWVVGPITLMLFAAITYYTSGLLADCYRTGDPLTGKRNYTYMDAVASYLSRLASVGLGVFQYVNLVGTAIGYTITASISAAAINKANCFHKNGRAADCGVYDSMYMVVFGVVQIFFSQVPNFHDLWWLSILAAVMSFTYASIAVGLSLAQTISGPTGKATLTGTEVGVDVDSAQKIWLAFQALGDIAFAYSYSMILIEIQDTVKVAAGGXQDDEEGNLMGVSTTTAFYMLCGCLGYAAFGNGAKGNILTGFGFYEPYWLIDFANVCIVVHLVGAYQVFCQPIFAAVETFAAATWPNAGFITREHRVAAGNGKRLGFNLNLFRLTWRTAFVMVSTLLAILMPFFNDVVGFLGAIGFWPLTVYFPVEMYIRQRGIPRYTTRWVALQTLSFLCFLVSLAAAVASIEGVTESLKNYVPFKTKS

SEQ ID NO: 1281 - protein, 258 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEGQGRGLDARRRCAVGVSTACMRFFLHYTPYYIIA

SEQ ID NO: 1282 - protein, 271 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 1283 - protein, 281 aa, Sorghum bicolor; identical to SEQ ID NO: 208

SEQ ID NO: 1284 - protein, 281 aa, Sorghum bicolor; identical to SEQ ID NO: 208

SEQ ID NO: 1285 - protein, 203 aa, Sorghum bicolor
MATGPVVPEEHHVRAVRQGRRRQQRRRQVLAGGGSWRWCGVREGELGRRAVPAQGGPQDVQELPGAVQGAREDVQLLHHWKLWVSRDERHEREQAGGSAQRLRVRADLRGQGRRLDARRRRAVGDVRRVMQAPSDHERIRSHWPRTKGHGEMQEQKLRRRLKACIASEHHGWVQEEPISIAFAALLASVSYRPCSPTPSLYIS

SEQ ID NO: 1286 - protein, 282 aa, Saccharum officinarum
MATDLGFEETELRLGLPGGGGGGGELGGEGRSSSSGKRGFAETIDLKLKLEPATPAAVVKAEEDDEQDDGGVALAAAKEAAAATEEAGGKMKRSPSQSSVVTAAAVQADPAEKPRAPKAQVVGWPPVRSFRKNIMSVQSDKGAGGSKDADKSSPAAAAAAAVGGAAFVKVSLDGAPYLRKVDLKMYKSYQELSKALEKMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 1287 - protein, 340 aa, Saccharum officinarum
MATDLGFEETELRLGLPGGGGGGGELGGEGRSSSSGKRGFAETIDLKLKLEPATPAAVVKAEEDDEQDDGGVALAAAKEAAAATEEAGGKMKRSPSQSSVVTAAAVQADPAEKPRAPKAQVVGWPPVRSFRKNIMSVQSDKGAGGSKDADKSSPAAAAAAAVGGAAFVKVSLDGAPYLRKVDLKMYKSYQELSKALEKMFSSFTIGSCGSQGMNGMNESKLVDLLNGSEYVPTYEDKDGDWMLVGDVPWEMFVESCKRLRIMKGSEAIGLRAEGHGEMQEQELRRRWKLASEHQGWMQEDPISTAFAALLVSVSYSSLSSKPLYLLINEVILVCQLFYLC

SEQ ID NO: 1288 - protein, 398 aa, Zea mays
MAHPSAAAAAVSSTAPAANPSSGAREEGGARSPPSPSPSQRGRAKVVIVMGATGAGKSRLAVDLAAHFAGVEVVSADSMQLYRGLDVLTNKAPLHEQNGVPHHLLSVIDPSVEFTCRDFRDRAVPIIQEIVDRGGLPVVVGGTNFYIQALVSPFLLDDMAEEMQGCTLRDHIDDGLTDEDEGNGFERLKEIDPVAAQRIHPNDHRKIKRYLELYATTGALPSDLFQGEAAKKWGRPSNSRLDCCFLWVDADLQVLDSYVNKRVDCMMDGGLLDEVCSIYDADAVYTQGLRQAIGVREFDEFFRAYLPRKESGEGSCASLLGMHDDQLKSLLDEAVSQLKANTRRLVRRQRRRLHRLSKDFGWNLHRVDATEAFFCKSIGTLSDAYAFSVATHNLPLIF

SEQ ID NO: 1289 - protein, 341 aa, Hordeum vulgare
MALPPASVEPVIAEVEMNAGADQGATTVRATVVQASSVFYDTPATLDKAEKLIAEAAGYGSQLVLFPEVFVGGYPHGSTFGLTIGSRSAKGKEDFRKYHAAAIDVPGPEVSRLAALAGKYKVFLVIGVVERAGYTLYNTVLSFDSLGKYLGKHRKLMPTALERVFWGFGDGSTIPVYDTPLGKIGAVICWENRMPLIRAAMYAKGVEIYCAPTADALPSWQSSMTHIALEGGCFVLTANQFCLRKDFPPPPEYTFGGHEEEPSPETAVCPGGSSIISPSGTVLAGPNYEGEALLTADLDLGEIVRAKFDFDVVGHYARPEVLSLTVKTEPKHAVSFTSTVG

SEQ ID NO: 1290 - protein, 341 aa, Hordeum vulgare; identical to SEQ ID NO: 1289

SEQ ID NO: 1291 - protein, 361 aa, Zea mays; identical to SEQ ID NO: 162

SEQ ID NO: 1292 - protein, 361 aa, Zea mays; identical to SEQ ID NO: 162

SEQ ID NO: 1293 - protein, 149 aa, Zea mays
MGSDTETEKKASVALMSIAKPLAGKKLCKRTLKLVRRASEAKCLKRGVKEVVKSIRRGNKGLCVIAGNISPIDVITHVPILCEEANVPYVYVPSKEDLATAGTTKRPTCCVLVLTKPNKGELSGEVKDKLKSDYDQVVTEVAEATSAMF

SEQ ID NO: 1294 - protein, 291 aa, Zea mays
MVHSWFCFRKSLLVATHMDLPLDWLSAIALPREKEDFQKYHASAIDVPGPEVSRLSALAGKYKVFLVIGVVERAGYTLYNTVLSFDPLGKYLGKHRKVMPTALERVFWGFGDGSTIPVYDTPIGKMGALICWENRMPLLRTAMYAKGIEIYCAPTVDCMPTWLSSMTHIALEGGCFVLSACQFCRRKNYPPPPEYTFCGLEEEPSPESVVCSGGSVIISPLGTVLAGPNYESEALLTADLDLGEIVRAKFDFDVVGHYSRPEVLSLVVKSDPKPAVSFISAAGRDDDYVQT

SEQ ID NO: 1295 - protein, 443 aa, Oryza sativa
MGLCSPSTPRQPLSTVALFAFGAGLLAYGVHLSYAHVEPQRARTLARDQFVRDYLKRKYDQVAHGLPPSPQRDPLPAQFLGRGGGAMALAPASSGSGPVVTEVEMNAGADQGATGTVRATVVQACTVFYDTPATLDKAEKLVAEAAGYGSQIVLFPEVFVGGYPHGSTFGLTIGNRSAKGKEDFHKYHAAAIDVPGPEVTRLAALAGKYKIFLVMGVVERVGYTLYNTVLFFDPLGKYLGKHRKVMPTGLERVFWGFGDGSTIPVYDTPIGKIGAVICWENRMPLLRTAMYAKGVQIYCAPTADFSPSWQASMTHIAVEGGCFVLSANQFCRRKNYPPAPEYTFGGLDEEPSPESVIWPGGSSIVSPSGTVLAGPNYEGEGLLTADLDLGEIARAKFDFDVVGHYARPEVLSLTVKTESKLPVSFTSAAEKNSAAKSDGISRT

SEQ ID NO: 1296 - protein, 357 aa, Oryza sativa
MALAPASSGSGPVVTEVEMNAGADQGATGTVRATVVQACTVFYDTPATLDKAEKLVAEAAGYGSQIVLFPEVFVGGYPHGSTFGLTIGNRSAKGKEDFHKYHAAAIDVPGPEVTRLAALAGKYKIFLVMGVVERVGYTLYNTVLFFDPLGKYLGKHRKVMPTGLERVFWGFGDGSTIPVYDTPIGKIGAVICWENRMPLLRTAMYAKGVQIYCAPTADFSPSWQASMTHIAVEGGCFVLSANQFCRRKNYPPAPEYTFGGLDEEPSPESVIWPGGSSIVSPSGTVLAGPNYEGEGLLTADLDLGEIARAKFDFDVVGHYARPEVLSLTVKTESKLPVSFTSAAEKNSAAKSDGISRT

SEQ ID NO: 1297 - protein, 361 aa, Sorghum bicolor; identical to SEQ ID NO: 949

SEQ ID NO: 1298 - protein, 363 aa, Sorghum bicolor; identical to SEQ ID NO: 946

SEQ ID NO: 1299 - protein, 312 aa, Sorghum bicolor; identical to SEQ ID NO: 947

SEQ ID NO: 1300 - protein, 348 aa, Sorghum bicolor
MALAPSRSGSEPVIPEVEMNAGADQAASTVRVTVVQASSVFYDTPATLDKVEKLIAEAAGYGSQLVLFPEVFVGGYPHGSTFGLVIGNRTAKGKEDFQKYHASAIDVPGPEVSRLSALAGKFKVYLVIGVVERAGYTLYNTVLSFDPLGKYLGKHRKVMPTALERVFWGFGDGSTIPVYDTPLGKIGALICWENRMPLMRTAMYAKGIQIYCAPTVDCMPSWQSSMTHIALEGGCFVLSASQFCHRKNYPPPPEYTFGGLEEEPSPESAVCSGGSVIISPSGTVLAGPNYESEALLTADLDLGEIVRAKFDFDVVGHYSRPEVLSLVVKTDPKPAVSFTSASEKTNAG

SEQ ID NO: 1301 - protein, 266 aa, Saccharum officinarum; identical to SEQ ID NO: 950

SEQ ID NO: 1302 - protein, 353 aa, Saccharum officinarum
  misc_feature (129)..(129): Xaa can be any naturally occurring amino acid
  misc_feature (131)..(131): Xaa can be any naturally occurring amino acid
  misc_feature (135)..(135): Xaa can be any naturally occurring amino acid
  misc_feature (289)..(289): Xaa can be any naturally occurring amino acid
  misc_feature (337)..(337): Xaa can be any naturally occurring amino acid
  misc_feature (343)..(343): Xaa can be any naturally occurring amino acid
MALAPSSSGSEPVIPEVEMNAGADQAASTVRVTVVQASSVFYDTPATLDKAEKLIAEAAGYGSQLVLFPEVFVGGYPHGSTFGLVIGNRTAKGKEDFQKYHASAIDVPGPEVSRLSALAGKYKVYLVIXVXERAXYTLYNTVLSFDPLGKYLGKHRKVMPTALERVFWGFGDGSTIPVYDTPLGKIGALICWENRMPLLRTAMYAKGIEIYCAPTVDCMPSWQSSMTHIALEGGCFVLSASQFCHRKNYPPPPEYTFGGLEEEPSPESVVCSGGSVIISPSGTVLAGPXYESEALLTADLDLGEIVRAKFDFDVVGHYSRPEVLSLVVKADPKPAVXFTSASXKTTLERAMTS

SEQ ID NO: 1303 - protein, 341 aa, Triticum sp.
MALSPASVGPVISEVEMNAGADQGATTVRATVVQACSVFYDTPATLDKAEKLIAEAAGYGSQLVLFPEVFVGGYPHGSTFGLTIGSRSAKGKEDFRKYHAAAIDVPGPEVSRLAALAGKYKVFLVIGVVERAGYTLYNTVLSFDSLGKYLGKHRKLMPTALERVFWGCGDGSTIPVYDTPLGKVGAVICWENRMPLIRTAMYAKGVQIYCAPTADALPSWQASMTHIALEGGCFVLTANQFCRRKDFPPPPEYTFGGHEEEPSPETAVCPGGSAIISPSGTVLAGPNYEGEALLTADLDLGEIVRAKFDFDVVGHYARPEVLSLTVKTEPKHAVSFTSTVG

SEQ ID NO: 1304 - protein, 461 aa, Zea mays; identical to SEQ ID NO: 212

SEQ ID NO: 1305 - protein, 466 aa, Oryza sativa
MDVEKVERKEVAVDDDGRVRTGTVWTATTHAITAVIGSGVLALPWSVAQMGWVLGPIALVVCAYITYYTAVLLCDCYRTPDPVHGKRNYTYMDVVRSCLGPRDVVVCGIAQYAILWGAMVGYTITTATSIMSVVRTNCHHYKGPDATCGSSGTMYMVLFGLAEVVLSQCPSLEGVTLISVVAAVMSFTYSFVGLFLSAAKVASHGAAHGTLLGVRVGAGGVTASTKAWHFLQALGNIAFAYTYSMLLIEIQDTVKSPPSENVTMKRASLYGIGVTTVFYVSIGCVGYAAFGNAAPGNVLTGFLEPFWLVDIANVAVVIHLVGAYQVYAQPVFACYEKWLASRWPESAFFHREYAVPLGGGRAVRFTLCKLVLRTAFVAVTTVVSLVLPFFNAVLGLLGAVAFWPLTVYFPVTMYMAQAKVQRGSRKWVALQALNVGALVVSLLAAVGSVADMAQRLRHVTIFQTQL

SEQ ID NO: 1306 - protein, 466 aa, Oryza sativa; identical to SEQ ID NO: 1305

SEQ ID NO: 1307 - protein, 198 aa, Zea mays
MQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSVAAAAGSIADVIAALKVYKPFSG

SEQ ID NO: 1308 - protein, 403 aa, Zea mays
  misc_feature (297)..(297): Xaa can be any naturally occurring amino acid
  misc_feature (320)..(320): Xaa can be any naturally occurring amino acid
  misc_feature (327)..(327): Xaa can be any naturally occurring amino acid
MLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAARAWPDSAFVSRDXAWGPLALSVFRLTWRSAFVCVTXVVAMLLXFFGNVVGFLGAVSFWPLTVYFPVEMYIKQRRVPRGSTKWVCLQTLSVACLVVSIAAAAGSIADVIEALKVYHPFSS

SEQ ID NO: 1309 - protein, 384 aa, Zea mays
  misc_feature (63)..(63): Xaa can be any naturally occurring amino acid
  misc_feature (79)..(79): Xaa can be any naturally occurring amino acid
  misc_feature (141)..(141): Xaa can be any naturally occurring amino acid
  misc_feature (150)..(150): Xaa can be any naturally occurring amino acid
  misc_feature (159)..(159): Xaa can be any naturally occurring amino acid
  misc_feature (163)..(163): Xaa can be any naturally occurring amino acid
  misc_feature (166)..(166): Xaa can be any naturally occurring amino acid
  misc_feature (179)..(179): Xaa can be any naturally occurring amino acid
  misc_feature (263)..(263): Xaa can be any naturally occurring amino acid
  misc_feature (286)..(286): Xaa can be any naturally occurring amino acid
  misc_feature (293)..(293): Xaa can be any naturally occurring amino acid
  misc_feature (338)..(338): Xaa can be any naturally occurring amino acid
  misc_feature (340)..(340): Xaa can be any naturally occurring amino acid
  misc_feature (361)..(361): Xaa can be any naturally occurring amino acid
  misc_feature (370)..(370): Xaa can be any naturally occurring amino acid
MDAVRSNLGGAKVAFCGAIQYANLVGVAIGYTIASSISMQAVSRAGCFHKRGHAVPCKSSSNXYMILFGAVQILFSQIXDFDQIWWLSIVAAVMSFTYSAIGLSLGIAQTVANGGFKGSLTGISIGADVTSTQKVWHTCRXSATSRSPTXSPTSSSRSXTRSXRRXVGVEGDAEGDAAXRGDDDHLLHAVRVHGVRGVRRQGAGQPADGVRLLRAILADRRGQRGHRGAPGGRVPGVLPAHLRLRGAPRRRAWPDSAFVSRDXAWGPLALSVFRLTWRSAFVCVTXVVAMLLXFFGNVVGFLGAVSFWPLTVYFPVEMYIKQRRVPRGSTKWVCLQTXSXRCLVVSIAAAAGSIADVIEAXKVYHPFSSXFLLLWMSWVGPGLA

SEQ ID NO: 1310 - protein, 440 aa, Arabidopsis thaliana
MSPAIKAPLLPNQEPSSSSSENHGSFAGAVFNISTSIVGAGIMAIPAAFKVLGVIPSLSIIVIIAWLSNVSAGFLMKSSLAGESTTYAGVMKESFGKSGAVAVTVVTMVVTFGSMIIFSIIIGDVISGNEKDGIIHLGLLQEWFGSHWWNTRFFGLLFIFVFLFLPLVLCRRVERLAFSSAISFLLALLFVGISSGLAIIALVQGKTKPPRLFPELNDGGLSFFSLFTASPVIVTAFTFHFNVHPVAFELKDPLNVLSATRISVILCATIYSATGLFCYLLFGDSTMTDVLMNFDQSTSSSVGSLLNDIVRLSYAIHLMLVFPLLNFSLRANLDELLFPMKLSLVEDNKRFFALTFPLLISCFLGAIAIPDIWYFFQFLGSTSTVSIAFIFPAAILLRNVNGFSTLREKIVASVMLVLAVATSIIAISTNIYTFTATEET

SEQ ID NO: 1311 - protein, 440 aa, Arabidopsis thaliana; identical to SEQ ID NO: 1310

SEQ ID NO: 1312 - protein, 435 aa, Arabidopsis thaliana; identical to SEQ ID NO: 214

SEQ ID NO: 1313 - protein, 427 aa, Arabidopsis thaliana; identical to SEQ ID NO: 215

SEQ ID NO: 1314 - protein, 589 aa, Arabidopsis thaliana; identical to SEQ ID NO: 216

SEQ ID NO: 1315 - protein, 532 aa, Arabidopsis thaliana
MEDKNNDKEKKTDVTFEDDEDNEDLEDNSSKYENDSETDQSDLGDLPGDAVDRDDDIDEPFISQVQWPQSFRETTDSYTIAASPIFGSLRSNPPSFYRASRSNLDVESKAPLLPERHDDSDKASATQSAWSHKGSFAEELPIGGYGCSVIQTIFNAINVMAGVGLLSTPYTVKEAGWASMVILLLFAVICCYTATLMKDCFENKTGIITYPDIGEAAFGKYGRILICMLLYTELYSYCVEFIILEGDNLTGLFPGTSLDLLGFRLDSKHLFGILTALIVLPTVWLKDLRIISYLSAGGVIATALIAVSVFFLGTTGGIGFHHTGQAVKWNGIPFAIGIYGFCYSGHSVFPNIYQSMADKTKFNKAVITCFIICVLLYGGVAIMGYLMFGEATLSQITLNMPQDQFFSKVAQVDNGCESVYKIRSPDESTCKEYRRTITGKNVREHMVLSSSKNSTRRFFCLFCFPYSIFWSYDGSYRISSQYTSGNNNASFMLHKDNGEQSNKNTDDSEFDHCGHRGGKRDLGDIFFGGKDH

SEQ ID NO: 1316 - protein, 294 aa, Arabidopsis thaliana; identical to SEQ ID NO: 218

SEQ ID NO: 1317 - DNA, 233 bp, Artificial sequence
  Codon optimized synthetic polynucleotide
tctagaggatcccccgggccaccatgggacaatgctcttcatctcagcatccagaggctgaacaacaaaagcaacagcaagctgctgcttgcgttgatattcagaagaggcaagagcagcttagaaaaaaagctgctgctcatatgaaccagccataccaggcttcatctaacgatgagcttgtgcttcttgtgtctctcgattctatcaccaagatcgggtgatgagagctc

SEQ ID NO: 1318 - DNA, 586 bp, Artificial sequence
  Codon optimized synthetic polynucleotide
gtcgactctagaggatccccgggcattgtgttggaaaagcaaagcaaatcaaagcacaacgagagggggagaaagagagagagagagagctatggggcagtgttcgtcctcccagcacccagaagcagagcagcagaagcagcagcaggcggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaatcagactgcctccatttgtcgatttacgaaattttatcacttaaacctgtctgtgtatttcagcaatgttttttgtaaaccgtccatgtatatgttgagaaaataatcacggagaccgcccttggtatcgatcgag

SEQ ID NO: 1319 - DNA, 338 bp, Artificial sequence
  Codon optimized synthetic polynucleotide
gtcgactctagaggatcccccgggccaccatggcaaagccatctcaggttctcgtttctgctcttgctgcttgggctgttgtgcttcttcttctttgcgctgctgctccaagaggtgctgatgctgctactgcttgcgatgctgctcaacttactccatgcgctggtgctattatcggatcttctccaccaactgctgcttgctgctctaggcttaaggaacaacagccatgcttgtgcacttacgctagagatccaaagctccagcgttacgtgtcatctccaaacggaaagaacgctatggctgcttgcaaggttccagttccatcttgctgatga

SEQ ID NO: 1320 - DNA, 548 bp, Artificial sequence
  Codon optimized synthetic polynucleotide
gtcgactctagaggatcccccgggccaccatggctatgccaagagctgctggtgctggatctcttagattcctcggacttcttaagcaaccagagtctgatgctgctgctccattcgagcttgatgagagggatgttgtttggccagcaggtggaggacaacaagatggatgggctgctccacctgctccaagaagaagagcacacgctgttccactttactcattcgggctctcatctcttcttgctgagggatgtggaggtggagttccagttcctgttccaggtagagctatggctccatctgctgctccaagacaatctgctccagttagagttccagctccatggccaggtggacgtagagctgatgaggatgaggaagatggtgaagaggttgtgccaccacatgttgttgctgctagaaggcatgctaggtcatcttcagttcttgagggtgctggaagaactcttaagggaagggatctcagatctgttaggaacgctgtgcttagacagactggattcctcgatctctgatgagagctc

SEQ ID NO: 1321 - DNA, 495 bp, Artificial sequence
  Codon optimized synthetic polynucleotide
atggctcaaagagataagaaggaagagccaactgaacttagggctccagagattgctctttgcgctaacaactgcggattcccaggaaatccagctactcagaacctttgccagtcttgcttctctgcttctaggtcatcttcttcatcttcacagccatctccaacctcttctccatctgcttcagctcctgctgctgctgttccacaacctagaccagctcttcttgatgctgctcttcaacttgctcctccagctgctgcagccggacaaccagttgaggcttctgctaggacttctgctaacaggtgctcttcttgccgtaagagagtgggacttactggattcagatgccgttgcggagatcttttctgcggtgctcacagatactctgataggcatgggtgccgttacgattatcgtggagctgctagggatgctattgctcgtgagaacccagttgttagggctgctaagatcgtgaggttctgatga

SEQ ID NO: 1322 - DNA, 260 bp, Artificial sequence
  Codon optimized synthetic polynucleotide
gtcgactctagaggatcccccgggccaccatgtctactactactcctaccaacgctgcttctcaacagggtgatgatgctgctgctgggggagctgataagaagccagctcaagagactgttaccaagactgttcagactgtggaagtgagatcttctgctggacaaccagatgaggaaggtgttctcaagccagttaaggtggtgcatgagatcccagctaaggattcttctggggtgaagcaggattgatgagagctc

SEQ ID NO: 1323 - DNA, 685 bp, Artificial sequence
  Codon optimized synthetic polynucleotide
tctagacccgggattgtgttgggcgtgagcacctgtgcccgactcaaccaatctactcgctgctacaacagagtttgcctgttgccttgcttccacctcccggctgcagctgcacctgctgctcgatcggatcggccgcgcgcggcatgtcgaccaccacccccaccaacgccgcctcccagcagggcgacgacgctgcggctggcggcgcggacaagaagccggcgcaagagacggtgacgaagacggtgcagacggtggaggtgcggtcctcggcagggcagcccgacgaggagggcgtgctcaagcccgtgaaggtggtgcacgagatccccgccaaggacagctccggcgtcaagcaggactaggactagctaagctgcctagctcgatcgatcatctagctaggatcgatgctgctgctgctaagctgagtggatttgatgctgctgcggtcagaaatcttatcgtcatttccaccccccaaccagatcctagctagtaattgcaaataaacaaatgttgcgttggatcctaatgtgaattagtgatctgtgcggcctgccgcttcatttgtaaacatgtactaataagacgcctgattttgtgttcgacacgatttgttgatcaagcgtcctaccgtttctcgagtatcccgttgagaaaataaacagttttttaaatc

SEQ ID NO: 1324 - DNA, 1137 bp, Artificial sequence
  Codon optimized synthetic polynucleotide
atggctccacaaactgctactagagtggcttctggaaggcttgttttcggtgctccaactactactgatgggaagctcgttaagggtggaagtaggcttagagtgcgttctctcgataacaacggaaggcgtgttgctgttgaggctgttaacggtgctgctagaccaaatggtgctgctgctgttgctgatgttagacaggttccagctccaccaccaccagagggtgatggtgatggtgttgctttcaggcttggaaagttcgctgagggtagacttgtttaccgtcagcagttcgttgttaggtcttacgagatcggaccagatagaactgctaccatggaaacccttatgaacctcctccaagagactgctcttaaccacgttatgtgctctggacttgctggtgatggattcggagctactaggcagatgtctctcaggaagctcatctgggttgtcactaggatcaacatccaagtggatgagtactcaagatggggagatgttgtggagatcgatacttgggttgcatcttctggaaagaacgggatgagaagggattggatcatcagggataggaacaccaagaacatgatcgctagggctacttctaactgggtgatgatgaacagagagaccagaaggctttctaagatcccagatgaagtgaggcaagaggttttgccattctacccagatcgttctattatcgctgctgctactggtggaggaagaaagatcgagaagctcaccgattctactgctgaacacatcaggtctggtcttgctccaagatggtctgatatggatgtgaaccagcacgttaacaacgtgaagtacatcggatggatcttggagtctgtgccacttgatgtgcttgaggattaccacctcacttctatcactctcgattaccgtagagagtgccgtcaatctcagcttcttgagtctctcacttctatgaccacctcttcttcagctccagctgaaccaccacttacatcttcactctgcgggagtgatctctactctactcaccttatcaggcagcaggatgatagagctgagatcgttagagcttgcgctgagtggagaagaaaggaacacccacgttctatcgagcagctttgatga

SEQ ID NO: 1325 - DNA, 566 bp, Artificial sequence
  Codon optimized synthetic polynucleotide
gtcgactctagaggatcccccgggccaccatgggaatttgcgtttcttgcgatgctgctgatgaaggtgctgctactgctagagttgtgcttccatctggggagcttagagagtatgctccacctgctactgctggaactgctcttcaagcagcaggtggagaaggaccatggcttctttgcgatgctgatggaatggctttcgagggaccagttgctgttgctgctgtggctcctggtgaagaacttcaggctgggcagatctactttgttctcccagctgagatgagaagaagaaggctcactagggaagaagttgctgctcttgctgttagagcttcttctgctcttgttaaggctgcacagccatcttctccatgccgtagacttagaagaggtgctgttgctccacttgttttcccagttccagaggaagaatacgctgctgctgatgctgtttctccagttgctgcaaagccacatcagaagcgtagagttgcttgccgttctggaagagcttctaggttctctccagatctcactgctattccagagtctgagtgatga

SEQ ID NO: 1326 - DNA, 740 bp, Artificial sequence
  Codon optimized synthetic polynucleotide
gtcgactctagaggatcccccgggccaccatggttctttctggtggacttgttgttccatggcttgctgctgctgttgctgtggctgctcttgctattactgctgctccagttggagctgatgcttacaagaactacaccgtgggagatgataaaggctggtatgatggactttctctcccaggtgttgattatcaggcttgggctgatggaaagaacttctctctcggggatttcctcatcttcaacaccgataagaaccactctgtggttcagactaggaacgtgactctttacgagtcttgcgattacaacgattctgggccagatgatactgttgaatgggtggcagctccaccagagttttctaaggatgctgtgactgtggctgttccacttcttgatgagggaagggcttacttcttctctggaaactacgatggtgaacagtgcgagtctggacaaagattcgctgtggatgttgctcatggacaaggacttccaccagatcttagaccaccagttgctgatgctccagctccatcttctgctggaccagctgatggtgctgctgctctcgatttctctcacccaaagaacgtgactactccatctgctaccgatgatgatgatgagcaactcggtggaggatctgcttcttcttctctcaggtctgctcttccagttactgctactctcctcatcactctcttgttcgctttcgctgtgtgatgagagctc

SEQ ID NO: 1327 - DNA, 1160 bp, Artificial sequence
  Codon optimized synthetic polynucleotide
gtcgactctagaggatcccccgggccaccatggatacttctaagtctaagcagggacctgagcatcttcttgttctcgtgcacggaattatggcttctcctaaggattggacttacggtgaagctgtgctcaagagaagattgggagatgatttcttcatctacgcttcatctactaactcttacactaagactttcgatggaatcgatgtggctggaagaagattggctaacgaagttctcgatgtggtgaacaagatgccttctctcagaaacatctctttcctcgctcattctcttggaggactcttcgctagatacgctatcgctatcctccatcctgtttctgtggagactaagaacgctggacaatcttctgctctcactgtgcctactactagaggacctgctaagtcaagatgtgcttctggactcggatctatcgctggacttcagcctatcaacttcatcactctcgctactcctcatcttggagtgagaggaagaaaccagcttcctttccttcagggactttctatccttgagaagctcgctgctcctcttgctccacttatcgtgggtagaactggtgctcagttgttcctcactgatggtgatccttctaagcctcctcttcttctccaaatggcttctgattgcgatgataagaactacatctctgctctcgctgctttcaagaacagagtgctctacgctaacgtgtcttacgatcacatggttggttggagaacttcttcactcagaagagagaagaacctcatcaagccttctcacagatctctcgatggatacaagcacatcgtgaacgttgagtactgctctcctgtttcttctgagggacctcactttccttctaaggctgctagagctaaagaagctgctcagagaactcctaacagagagaacactgaagagtaccaccagatgatggaagaagagatgcttcacggactccaaaaagtgggatggaagaaagtggatgtgaacttccactcttctttctggccttactctgctcataacaacatccacgtgaagaacgagtggcttcataatgctggtgctggtgttattgctcacgtggctgattctatcaagcagcaagagtcaagaccttgtctccctgctaacctctgatga

SEQ ID NO: 1328 - DNA, 524 bp, Artificial sequence
  Codon optimized synthetic polynucleotide
gtcgactctagaggatcccccgggccaccatggtttctggatctatctctgaggaaatcgctgttgctgttccagctgagagaatgtggaaggttgcattcgctgagactaagtctgctcttcttccaaaggcttgcgctggatacgttgatgctgtggaagttgatggtgatggtggaccaggatctgtgactaccatgaagctcaacccatctcttggagagaacaagacccttaagtctagggttgtggctcttgatgctgctgctagagttgttaggactgaggttctccaaggtggaactgtttctgctcagttgaggactcatttcgctgagattagggttgaagctgctggtgaaggggcttgtgttgctaaagtgaaagtggattacgagaggcttgatggtgctccacttgctccagaggatgaggctagacttgctcagggatacgttaggcttgttaggatggtggaggcttaccttgttgctcatccagatgagttcgcttgatgagagctc

SEQ ID NO: 1329 - DNA, 681 bp, Artificial sequence
  Codon optimized synthetic polynucleotide
atggctgcttcatcttacttcctcctcgctgctttccttgctgttactgcttctcacgctactgcttcagatccatctccactccaggatttctgcgtggctgatatccattctccagtgaaggttaacggattcgtgtgcaaggacccaatggctgtgactccagatgatttcttcaaggctgctaaccttgataaggctagggataccatgaagtctaaagttgggtctaacgtgactctcatcaacgttatccagcttccaggacttaacactctcggaatctcacttgctaggatcgattacgctccacttggagagaatccaccacatactcatccaagggctactgagatccttactgtgcttgagggaactctttacgtgggattcgtgacctctaacccaaacaagctcttcgctaaggttctcaacaagggggatgttttcgttttcccacagggacttatccatttccagttcaacccagtgtacgataagccagctgttgctatcgctgctctctcttctcaaaacccaggggttatcactattgctaacgctgtgttcggatctaagccaccaatctctgatgatgtgctcgctaaggctttccaagttgagaaggggactatcgattggcttcaagctcaattctgggagaacaaccactactgatga

SEQ ID NO: 1330 - DNA, 640 bp, Artificial sequence
  Codon optimized synthetic polynucleotide
gtcgactctagaggatcccccgggaggcctccaccatggctgctattactgctggacttcttgtgcttcttgctgctgctgttgctgctccagctcatgctactgattacaccgtgggagattcttcaggatggtctagtggagtggattacgctacttgggcttctggaaagactttcgctgctggtgataaccttgtgttccagtactctgctatgcatactgttgtggaggtgtcatctgctgattacggtgcttgctctgcttctaactctatccagtcttactcagatcagaacaccaagatcgctcttactgctccaggaaccagatacttcatctgcggaactccaggacattgcggaaacggaatgaagctcgctgttactgttgctgctggaactgctactactaccccagcttcttctccacctgctgctgattctccaccagagactgctactccatctggatctactccaactgctaccacttctccatctgctccaactactaagccaacctcttcttctactggtgctgcttgtggaggtgaagctagacttgctatgggagttcttgcttgggctgctggacttgctggtcttgctctcatgggatgatgatcactagtctcgag

SEQ ID NO: 1331 - DNA, 460 bp, Artificial sequence
  Codon optimized synthetic polynucleotide
gtcgactctagaggatccccgggccaccatgggaaagttgtggactatcctcactcatctccattctcttgctggaccaactgtgatgcttctctacccactttacgcttcagttagggctatggaatctccatctaagctcgatgatgagcagtggcttgcttactggattctctactctttcgtgaccctcatggaaatgcttttggagtctctcatctactggattccaatttggtacgagttgaagctccttttcatcgcttggcttgtgcttccaaacttcagaggtgctgctttcatctacgataagttcgtgagagagcagcttagaaagcacggacttactgctgctggatctgtgaagtcatcttctccatcttctaaggataaggataagccaaagaacaagttcctcgcattcgtgactccaaagaaggatcacgaggcttactgatga

SEQ ID NO: 1332 - DNA, 544 bp, Artificial sequence
  Codon optimized synthetic polynucleotide
gtcgactctagaggatcccccgggaggcctccaccatggctcaaagggataagaaggaagagccaactgaacttagggctccagagattactctttgcgctaacaactgcggattcccaggaaatccagctactcagaacctttgccagtcttgcttctctgcttctaggtctccatcttctccaacctcttcatcttcttctctcgcttcagctgcttctcaacctagaccagctgctcttgttgttgatgctgctgctgttgaagctcttgctgctccagcagcagcagctgtgggtcaagctactgaggctgctgctagagcttctgcttcaaggtgctcttcttgccgtaagagagtgggacttactggattcagatgccgttgcggagagcttttttgcggtgctcacaggtactctgataggcatgggtgctcttacgattatcgtggagctgctagggatgctattgctcgtgagaacccagttgttagggctgctaaggttgtgaggttctgatgatcactagtctcgaggagctc

SEQ ID NO: 1333 - DNA, 916 bp, Artificial sequence
  Codon optimized synthetic polynucleotide
gtcgactctagaggatccccgggccaccatgaagagaccaacttctagggggtcatctatggtttctggacaggctactactgatctccaagaggattcttgccgttctatggaaccacatggtgttgatggtgatgctactgctgctgctgagagggatgatgttgatgctggtgcttacgatgaggaagtggatgaggaagaggaacttgctggatctaggggaggacttggagagaagaagagaaggttggcagcagatcaagttagggctcttgagagatctttcgaagtggataacaagctcgatccagagagaaaggctaggatcgctagggatctttctcttcatccaaggcaagttgctgtttggttccagaacagacgtgctagatggaaaactaagcagatcgagagagatttcgctgctcttagagtgagacatgatgctcttagggttgagtgcgatgctcttcgtagagataaggatgctctcgctgctgagattaaggaacttagggggatggttgagaagcagatggaagtgaagttggagtctgctgctgaggaacttcttccagtggctactagatcagccgcagcagccgctgtttacaacaaggatgggtctaccgattctgattcttctgctgtgttcaacgaagaggcttctccatacccatattctggtgctgctctcgatcatcaacagcagcaagagacttctcatccactcggattcactgggttcacatctttcctcacctcttcattcccatctgtgtaccacggtgattctcatttggatcaagaggctgatggattcttcagtgctgctgcagctggagatggtttctttgctgaggaacagtctgctggaattggatcttggtacggtggagagggatggtgatga

SEQ ID NO: 1334 - DNA, 825 bp, Artificial sequence
  Codon optimized synthetic polynucleotide
atggaatgggttgataggactaaggcttctgctgctgccgctgccgcagccgctgatgagagggcaggtggagctgaaggacttgctggatacgtgaaggttatgaccgatgagcagatggaagttctcaggaagcagatctctatctacgctactatctgcgagcaactcgttgagatgcatagggctcttactgagcatcaggataccattgctgggatcaggttctctaacctctactgcgatccacagattattccagggggacacaagattactgctagacagagatggcaacctactccaatgcaactccagatccttgagaacatcttcgatcagggaaacggaactccatctaagcagaggatcaaggaaatcaccgctgagttgtctcatcatgggcagatctctgagactaacgtgtacaactggttccagaacagaagagctaggtctaagaggaagcaggctgcctctcttccaaacaacgctgagtctgaggctgaagtggatgaggaatctctcaccgataagaagccaaagtctgatcgttctctccaggataacaaggctatgggtgctcataacgctgataggatctctggaatgcaccaccttgataccgatcacgatcagatcggaggaatgatgtacggatgcaacgataacggactcaggtcatctggatcttcagggcagatgtctttctacgggaacatcatgccaaacccaaggatcgatcacttcccaggaaaggttgagtcatctcgttctttctctcatctccaacatggggagggattcgatatgttcggatgatga

SEQ ID NO: 1335 - DNA, 1655 bp, Artificial sequence
  Codon optimized synthetic polynucleotide
gtcgactctagaggatcccccgggccaccatggctccagaaaagcctcgtaaggaacaagaagaggaacttatgcttgaggatgggggaattgaggaatctccaaggcgttctttcgaggattgcggggattctgaggaagataggggggagggtgatgatgaggaagagagggattctgatagggatggtgttggatctaccagatctttcctcccacaaaagtggccacaatcttaccgtgagaccactgatacttacaccatcgctgcttctccatctttcggatacctcgggtcatctacctctaagtactcactccttgatctcggaagatctatcctcggatctgatctcaagtctccactcatctctgctaaggctgattctgtgaggaacctcccaaagactcttggatctatgagggatggaagggtgtcattccagcttcaacataccggggagatctacatttctcagggatgcaacgttactcagactgtgttcaacggtatcaacgttcttgctggtgttggacttctctctaccccattcactattcatgaggctggatggactggacttgctgttcttgtgtgcttcgctatcgtttgctgctacactggaatccttctcaagcactgcttcgagtctaaggatgggatctcttcttacccagatattggggaggctgctttcggaagaattggaaggctcctcatctctatcatcctctacaccgagctttacacttactgcgtggagttcatcattctcgagggtgataacctcactaccatcttcccaaaggctggtgttgattggttcggaatccacgttgatggaaagcacttcttcggagtgcttactgctatccttgtgcttccaactgtttggcttagggatcttagggtgctctcttacctttcagctgggggagttatcgctactcttctcgtgttcctttctgttggacttgtgggagctactgatggaatcggattccactctactggaaaggctgttaactggtctggaatgccattcgctatcggaatctacggattctgctactctggacactctgtgttcccaaacatctaccagtctatgtctgataggtctaagttccctaaggctctcttcatctgctttgctatctgcactgctatctacggatctttcgctgtgatcggattccttatgttcggaaagaacaccctctctcagatcactcttaacctccctaagcactctttcgcttcagaagtggctctttggactactgtgatcaacccattcaccaagttcgctcttctcttgaacccactcgctagatctcttgaggaacttaggccagagggattcatgaacgagacatcttgcgctatcatccttaggactgctcttctcgcttctactgtgtgcattgctttcctcttgccattcttcggacttgtgatgtctcttatcgggagtctcctttctatccttgtggctgtgatcatgccaccactttgcttccttaagatcgctcagaacaaggctacttgcgctcaagttatcgcttctatctgcatcgttatgctcggagttatctctgctgctctcggaacttactcttctgtgaagaagatcgttgagaactactgatga

SEQ ID NO: 1336 - DNA, 1331 bp, Artificial sequence
  Codon optimized synthetic polynucleotide
gtcgactctagaggatcccccgggccaccatgggatttggaatggggaacaacaacaacggtgcttcttcttcttcatctaggctcgatccagctgctccacttcttccaaggcatggatcttcaggtggaagagagggtggaggactttcttctcagccaaagaccttcgctaacgtgttcatcgctgttgttggagctggtgttcttggactcccatacactttctctaggactggatgggctgctggatctcttcttctcttctctgtggctgctcttactttctactgcatgatgcttttggttgcttgccgtagaagattggctgatgagcacccaaagatcgcttcattcggagatcttggggatgctgttttcggtgctcatggaaggttcgctgtggatgtgatgcttgtgctcaaccagttctctttctgcgtgggatacctcatcttcatctctaacaccatggctcatctctacccaattaccgctgctgcttcttcatcttctgctctcctctcaccaaaggctcttgttatctgggctatgcttccattccagctcggactcaactctatcaagactctcactcttctcgctccactttctatcttcgctgatgtggtggatcttggagctatgggagttgttcttggacaagatgtggctgcttggcttgcaaagccagttccagttgttgctttcggaggtgctggtgctcttctttacggacttggggtttcagtttacgctttcgagggaatcggaatggttcttccacttgaggctgaggctgctaacaagtctaagttcggagtgactctcggactttctatggctttcatcgctgtgatgtacggacttttcggagttatgggatacgttgctttcggtgatgctaccagggatatcatcactactaacctcggagctggatggctttctgctgctgttcaacttggactctgcatcaaccttttcttcaccatgccagtgatgatgaacccagtttacgaagttgctgagaggcttcttcatggaaagcgttactgttggtggcttagatggcttcttgttgtggttgttggactcgctgctatgtacgtgccaaacttcactgatttcctcgctcttgtgggatcttctgtgtgcgttcttcttggattcgtgctcccagcttctttccatcttaaggtgttcggagctgagatggaatggccaggtgttctttctgatgtgctccttgtggttatcggacttgctttggctgttttcggaacctacacttctcttctccagatcttccagtcatcttcagcttgatga

SEQ ID NO: 1337 - DNA, 877 bp, Cauliflower mosaic virus
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 1338 - DNA, 1113 bp, Arabidopsis thaliana
tatgtcgactcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaacccgggac

SEQ ID NO: 1339 - DNA, 1154 bp, Arabidopsis thaliana
cttctgctttttatccatgaggatatgaagctgacagtaattggtgagtgccatggccttagatttgcatccactaccacaagcaacacaattaccagccttaacgccatcgttgttgttattatcattatctccgctaccttcaatttcatccccagtttgtccttcaaccttacgtctcttgttttggtgataattctcatctttgaaaggactaacaccatagttccagctataatatctatgttgtgccttgagatcctccattagagcccagtaatggtctctgtagcatctagagagctgcttcaggttgtgcgatctgcgtcggagaagctccgggcgagtgaggtgattggaatttcccaggatctgatcctccaccgccatcgaaatcggtgaattcgatgacgtcgacgggttattagggtttcgaaattgggattcctccaatacaccggatttcgagggggttgaagcaatgatcggagatggatgcctaggaggtttggaagaagaagggttttgcttggaagctgacgccattgttactgttggaaaacaagggagagagaaagagagtggcgaagagtggctagaggaaagacaaggacgagacaggaaactctggcaaaattgacatttatagaaaggccttacttaaaagcccaatgggccataacatgaaccgaaaacccatgaaaaaaatcgaagtagaccgattggtttaaatcaggttctgctggtgtgcggctgtcggtggaaggctccacttcagtaaagtagggcccacaacacgaaccaggctgtcttgtctaaccgacacatacattacaccaaacgcaatcttcaccgttgattgttctctaatccaacggttgatagagactgctgatccgtcacccgctttagtttagtgtttcttcttcctcctctctttcccaagaatctcttccttattttctcggcaacgaagcaaaaagggtaatttttgtcggttgaattcacaagctagttttctcgatctctctctggatctatagctgatctgcattgcgggtaagcattttttccacaagtacttatgcctaattttggtaacgatttagctaaatcttgactagagaattttgtttcgttgcttggttattgga

SEQ ID NO: 1340 - DNA, 1480 bp, Gossypium hirsutum
cccgggtaccattactctactacagctgctatcattactacatacatgtccacccaaagtcgagcagttggcggcaccgagcacaactggtgccgagcggtggtcgggggaaccgggatagccgtcttggctatcatttcttccaaaaaccccgacgtttcacatcttaaaaatgccctccacaagctccaaatctcccatcccattcttaggtctcgcctccattacagtcctactgccaacagttactccttcgttacctccccctcccctttcattcaaatcaagtactttaaccattctacaacttgtcaaatccttgaaaacaaccaaaacatctcaccccttcatttgattctcgaacacgagcttaaccaaaacgcttgggttagttcttcatgtaccaccaaacacgacgtgtttttcgccagtgtttatgccttgcctggtgcaacaaggtgggtgttggtgctccgcctacatgcggctgcttgtgaccggaccacggcggtgtcgttgctgagagagttgttgacgttaatggctattgaggaggaggaaacagggtttcagcaaggtcaaaaagaaattacgatgaacaaaggagagatcagtttggccatggaagatattcttccaaaaggcattgttaagaaaacactttgggcacgaggagtggacatgctaagctactctgttaattctttaaggttcacgaacttgaggttcaaagatgccaaatctcctagatctactcaagtagtgaggttgcttatcaaccctgatgacactcagaagatcttgactggttgcaaggcaagagggattaagttatgtggagcattaggagctgccgggctgatttctgcacacagttctaaaagccgttcagatcatcaaaagaagaaatatggcgttgtaacactcacagattgccgctcaattcttgaacctccgctctccaatcaccatttcggtttttaccactcagctattctgaacacgcacgccatcaaaggaggagagaagctttgggagctagcagagaaagtgtacaccgtatttacacactacaagagctgcaacaagcacttgtcagacatggcagacctgaatttcttaatgtgcagggccatggagaaccctggcttgactccatctgcctcattgaggacatgtttgatatcggtcttcgaggatacggtgatagatgagtctagtaaccagcaaaatcaagtcggcgtagaggactatatgggatgcgcttccgctcatggcatcgcgccgtccatcgcgatattcgacaccatacgagatgggcgactggattgcatttgcgtttatccttcgccgttgcattcaagggaacaaatgcaggagctggttgataatatgaagtgcatacttgtggatgcagggaagaatgttgctgatgaaactgagagttaaggagccagtctggtctttgtctgttgagctc

SEQ ID NO: 1341 - protein, 467 aa, Gossypium hirsutum
MSTQSRAVGGTEHNWCRAVVGGTGIAVLAIISSKNPDVSHLKNALHKLQISHPILRSRLHYSPTANSYSFVTSPSPFIQIKYFNHSTTCQILENNQNISPLHLILEHELNQNAWVSSSCTTKHDVFFASVYALPGATRWVLVLRLHAAACDRTTAVSLLRELLTLMAIEEEETGFQQGQKEITMNKGEISLAMEDILPKGIVKKTLWARGVDMLSYSVNSLRFTNLRFKDAKSPRSTQVVRLLINPDDTQKILTGCKARGIKLCGALGAAGLISAHSSKSRSDHQKKKYGVVTLTDCRSILEPPLSNHHFGFYHSAILNTHAIKGGEKLWELAEKVYTVFTHYKSCNKHLSDMADLNFLMCRAMENPGLTPSASLRTCLISVFEDTVIDESSNQQNQVGVEDYMGCASAHGIAPSIAIFDTIRDGRLDCICVYPSPLHSREQMQELVDNMKCILVDAGKNVADETES

SEQ ID NO: 1342 - DNA, 1027 bp, Gossypium hirsutum
tctagatgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagcacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgttggagacccttttaattacctatatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcagtgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctgacggaacaaaagccaaagcagtagcagtctgccacacagatacatcagcatggaaccctaagcatttggcttttcaagtcctaaaagttgaaccaggaaccattcctgtctgccatttccttcctcgggatcacattgtttgggtccctaagtaaaaatcctggagctc

SEQ ID NO: 1343 - protein, 335 aa, Gossypium hirsutum
MKVLSPILACLALAVVVSHAALSPEQYWSYKLPNTPMPKAVKEILHPELMEEKSTSVNVGGGGVNVNTGKGKPGGDTHVNVGGKGVGVNTGKPGGGTHVNVGDPFNYLYAASETQIHEDPNVALFFLEKDMHPGATMSLHFTENTEKSAFLPYQTAQKIPFSSDKLPEIFNKFSVKPGSVKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 1344 - DNA, 20 bp, Artificial sequence
  single strand DNA oligonucleotide
cctgactgaacgcggctact

SEQ ID NO: 1345 - DNA, 21 bp, Artificial sequence
  single strand DNA oligonucleotide
caatggtgatgacctgtccgt

SEQ ID NO: 1346 - DNA, 21 bp, Artificial sequence
  single strand DNA oligonucleotide
ggaaaggcaaagtctggcttg

SEQ ID NO: 1347 - DNA, 21 bp, Artificial sequence
  single strand DNA oligonucleotide
gcacgggacctagagtgaacc

SEQ ID NO: 1348 - DNA, 25 bp, Artificial sequence
  single strand DNA oligonucleotide
ggacagctctcctagatctctctga

SEQ ID NO: 1349 - DNA, 25 bp, Artificial sequence
  single strand DNA oligonucleotide
ctaaaccgctaaattaaactgcgag

SEQ ID NO: 1350 - DNA, 21 bp, Artificial sequence
  single strand DNA oligonucleotide
gtgaacatgctctccttgcgt

SEQ ID NO: 1351 - DNA, 20 bp, Artificial sequence
  single strand DNA oligonucleotide
atttgggagtggttgcatcc

SEQ ID NO: 1352 - DNA, 21 bp, Artificial sequence
  single strand DNA oligonucleotide
acttccactgcgcgtagatga

SEQ ID NO: 1353 - DNA, 23 bp, Artificial sequence
  single strand DNA oligonucleotide
acggaataatgacgatgaaccac

SEQ ID NO: 1354 - DNA, 19 bp, Artificial sequence
  single strand DNA oligonucleotide
cgagcgactcaaaccatgc

SEQ ID NO: 1355 - DNA, 21 bp, Artificial sequence
  single strand DNA oligonucleotide
tcttggtgattgaatccagcg

SEQ ID NO: 1356 - DNA, 22 bp, Artificial sequence
  single strand DNA oligonucleotide
gcatggtgggtaaggttttctt

SEQ ID NO: 1357 - DNA, 23 bp, Artificial sequence
  single strand DNA oligonucleotide
caatcttggtgattgaatccagc

SEQ ID NO: 1358 - DNA, 22 bp, Artificial sequence
  single strand DNA oligonucleotide
caccatccacgcactagtacgt

SEQ ID NO: 1359 - DNA, 21 bp, Artificial sequence
  single strand DNA oligonucleotide
cagctagccgcttcgagagat

SEQ ID NO: 1360 - DNA, 21 bp, Artificial sequence
  single strand DNA oligonucleotide
aagacgccgatcgatacattg

SEQ ID NO: 1361 - DNA, 27 bp, Artificial sequence
  single strand DNA oligonucleotide
acgtattgagttcagttcttcatgtgt

SEQ ID NO: 1362 - DNA, 23 bp, Artificial sequence
  single strand DNA oligonucleotide
ccattcagaggatatttgggtga

SEQ ID NO: 1363 - DNA, 24 bp, Artificial sequence
  single strand DNA oligonucleotide
aatacttgcgaccatgtctatcca

SEQ ID NO: 1364 - DNA, 21 bp, Artificial sequence
  single strand DNA oligonucleotide
ccagtccacaatctccctgcc

SEQ ID NO: 1365 - DNA, 19 bp, Artificial sequence
  single strand DNA oligonucleotide
gtcgtgcgcctggccaaag

SEQ ID NO: 1366 - DNA, 23 bp, Artificial sequence
  single strand DNA oligonucleotide
ctgcggtcagaaatcttatcgtc

SEQ ID NO: 1367 - DNA, 21 bp, Artificial sequence
  single strand DNA oligonucleotide
cgaacacaaaatcaggcgtct

SEQ ID NO: 1368 - DNA, 20 bp, Artificial sequence
  single strand DNA oligonucleotide
cttccggctgggtaagtttg

SEQ ID NO: 1369 - DNA, 20 bp, Artificial sequence
  single strand DNA oligonucleotide
atggttcagtgccgtctcct

SEQ ID NO: 1370 - DNA, 23 bp, Artificial sequence
  single strand DNA oligonucleotide
aagaagaagcgacacagctcaac

SEQ ID NO: 1371 - DNA, 21 bp, Artificial sequence
  single strand DNA oligonucleotide
gcagcagtaggatgtgcgatc

SEQ ID NO: 1372 - DNA, 22 bp, Artificial sequence
  single strand DNA oligonucleotide
cagctcaactgctcaaggacag

SEQ ID NO: 1373 - DNA, 19 bp, Artificial sequence
  single strand DNA oligonucleotide
ggcgcagcagtaggatgtg

SEQ ID NO: 1374 - DNA, 23 bp, Artificial sequence
  single strand DNA oligonucleotide
cgatgcctacaagaactacaccg

SEQ ID NO: 1375 - DNA, 23 bp, Artificial sequence
  single strand DNA oligonucleotide
agtggttcttgtccgtgttgaag

SEQ ID NO: 1376 - DNA, 23 bp, Artificial sequence
  single strand DNA oligonucleotide
gccgatgcctacaagaactacac

SEQ ID NO: 1377 - DNA, 20 bp, Artificial sequence
  single strand DNA oligonucleotide
tgaagatgaggaaatccccg

SEQ ID NO: 1378 - DNA, 21 bp, Artificial sequence
  single strand DNA oligonucleotide
tcctgttacagatggcatccg

SEQ ID NO: 1379 - DNA, 25 bp, Artificial sequence
  single strand DNA oligonucleotide
tctctctccttagtgaagacgttcg

SEQ ID NO: 1380 - DNA, 26 bp, Artificial sequence
  single strand DNA oligonucleotide
agaatcttataaagccctcacatcgt

SEQ ID NO: 1381 - DNA, 20 bp, Artificial sequence
  single strand DNA oligonucleotide
gatgacacgggcgaacagta

SEQ ID NO: 1382 - DNA, 20 bp, Artificial sequence
  single strand DNA oligonucleotide
ccgccacctttcctacgtac

SEQ ID NO: 1383 - DNA, 23 bp, Artificial sequence
  single strand DNA oligonucleotide
tcggtctatactcgattcgaagc

SEQ ID NO: 1384 - DNA, 26 bp, Artificial sequence
  single strand DNA oligonucleotide
tctgtgttgctgatattcactctcct

SEQ ID NO: 1385 - DNA, 27 bp, Artificial sequence
  single strand DNA oligonucleotide
ccttactcttcatggtgtctctagctt

SEQ ID NO: 1386 - DNA, 19 bp, Artificial sequence
  single strand DNA oligonucleotide
ggccgcctgttaggagcta

SEQ ID NO: 1387 - DNA, 22 bp, Artificial sequence
  single strand DNA oligonucleotide
cgcctcactcctaccttcatct

SEQ ID NO: 1388 - DNA, 21 bp, Artificial sequence
  single strand DNA oligonucleotide
aagaggcagtgctgtttccgt

SEQ ID NO: 1389 - DNA, 21 bp, Artificial sequence
  single strand DNA oligonucleotide
gccagaatcgagcatagacca

SEQ ID NO: 1390 - DNA, 24 bp, Artificial sequence
  single strand DNA oligonucleotide
gcatcaaagagtggtcaattcaca

SEQ ID NO: 1391 - DNA, 19 bp, Artificial sequence
  single strand DNA oligonucleotide
caccctcctttgcagtgca

SEQ ID NO: 1392 - DNA, 22 bp, Artificial sequence
  single strand DNA oligonucleotide
ccaagtcgtctcttagtccgga

SEQ ID NO: 1393 - DNA, 19 bp, Artificial sequence
  single strand DNA oligonucleotide
caggatgcacgtcttgcct

SEQ ID NO: 1394 - DNA, 24 bp, Artificial sequence
  single strand DNA oligonucleotide
atgtgcaacgaccctactaactcc

SEQ ID NO: 1395 - DNA, 19 bp, Artificial sequence
  single strand DNA oligonucleotide
tcagtgtcctcagcgcgat

SEQ ID NO: 1396 - DNA, 24 bp, Artificial sequence
  single strand DNA oligonucleotide
ctcgagcatcactcaaaccactac

SEQ ID NO: 1397 - DNA, 19 bp, Artificial sequence
  single strand DNA oligonucleotide
gccaggcccattgaatcac

SEQ ID NO: 1398 - DNA, 24 bp, Artificial sequence
  single strand DNA oligonucleotide
cagcgctgtatggtaaaggtattg

SEQ ID NO: 1399 - DNA, 19 bp, Artificial sequence
  single strand DNA oligonucleotide
tgtgtcatggaggcttgcc

SEQ ID NO: 1400 - DNA, 22 bp, Artificial sequence
  single strand DNA oligonucleotide
gccaccaactccattcaacttt

SEQ ID NO: 1401 - DNA, 24 bp, Artificial sequence
  single strand DNA oligonucleotide
ctcttattcatgggcttaattgca

SEQ ID NO: 1402 - DNA, 23 bp, Artificial sequence
  single strand DNA oligonucleotide
gacgctctgattaggctagggac

SEQ ID NO: 1403 - DNA, 18 bp, Artificial sequence
  single strand DNA oligonucleotide
ccctgctgttacgtggcc

SEQ ID NO: 1404 - DNA, 22 bp, Artificial sequence
  single strand DNA oligonucleotide
tcagtgaagatgaggctcgcta

SEQ ID NO: 1405 - DNA, 24 bp, Artificial sequence
  single strand DNA oligonucleotide
tcccatctagaagtgtgttctcca

SEQ ID NO: 1406 - DNA, 24 bp, Artificial sequence
  single strand DNA oligonucleotide
tgtgagcatcaactctaacatgga

SEQ ID NO: 1407 - DNA, 27 bp, Artificial sequence
  single strand DNA oligonucleotide
tgacataaatttcacacattcacatca

SEQ ID NO: 1408 - DNA, 24 bp, Artificial sequence
  single strand DNA oligonucleotide
ctatggaaatttgtcaccgtgatc

SEQ ID NO: 1409 - DNA, 21 bp, Artificial sequence
  single strand DNA oligonucleotide
tcgcaaattttcacacgaggt

SEQ ID NO: 1410 - DNA, 23 bp, Artificial sequence
  single strand DNA oligonucleotide
ccgatgagctaggagaagtgttg

SEQ ID NO: 1411 - DNA, 20 bp, Artificial sequence
  single strand DNA oligonucleotide
tttggccgattgggtatgtc

SEQ ID NO: 1412 - DNA, 24 bp, Artificial sequence
  single strand DNA oligonucleotide
attgcagagagggaaaacgtaaga

SEQ ID NO: 1413 - DNA, 24 bp, Artificial sequence
  single strand DNA oligonucleotide
aaatcaaacacgtccaagaacatc

SEQ ID NO: 1414 - DNA, 24 bp, Artificial sequence
  single strand DNA oligonucleotide
aaatatttgtcctatgggaatggg

SEQ ID NO: 1415 - DNA, 28 bp, Artificial sequence
  single strand DNA oligonucleotide
agtataatagttctgtccaaagttgcgt

SEQ ID NO: 1416 - DNA, 19 bp, Artificial sequence
  single strand DNA oligonucleotide
ggttgcgcgctctgactta

SEQ ID NO: 1417 - DNA, 21 bp, Artificial sequence
  single strand DNA oligonucleotide
ccaacgactcgccttcctaac

SEQ ID NO: 1418 - DNA, 26 bp, Artificial sequence
  single strand DNA oligonucleotide
ctttgtaaaccaatgccatcagttag

SEQ ID NO: 1419 - DNA, 22 bp, Artificial sequence
  single strand DNA oligonucleotide
gctggactctcttcacttcgct

SEQ ID NO: 1420 - DNA, 20 bp, Artificial sequence
  single strand DNA oligonucleotide
gcactgatcaatgccgactg

SEQ ID NO: 1421 - DNA, 25 bp, Artificial sequence
  single strand DNA oligonucleotide
aaggattggatcggatacttgtaga

SEQ ID NO: 1422 - DNA, 21 bp, Artificial sequence
  single strand DNA oligonucleotide
ttatccatgataccccgctga

SEQ ID NO: 1423 - DNA, 21 bp, Artificial sequence
  single strand DNA oligonucleotide
gtgcttgttgacttgacgacg

SEQ ID NO: 1424 - DNA, 22 bp, Artificial sequence
  single strand DNA oligonucleotide
agcagccgctgtgtataacaag

SEQ ID NO: 1425 - DNA, 21 bp, Artificial sequence
  single strand DNA oligonucleotide
ggaagggaaagaggacgtcaa

SEQ ID NO: 1426 - DNA, 25 bp, Artificial sequence
  single strand DNA oligonucleotide
tgaacctactctttgggatagctgt

SEQ ID NO: 1427 - DNA, 26 bp, Artificial sequence
  single strand DNA oligonucleotide
acgtggagaattacatgctgatagtt

SEQ ID NO: 1428 - DNA, 28 bp, Artificial sequence
  single strand DNA oligonucleotide
accattgttagtgacttaattaccctca

SEQ ID NO: 1429 - DNA, 22 bp, Artificial sequence
  single strand DNA oligonucleotide
cgaaatcgatagaccacacacg

SEQ ID NO: 1430 - DNA, 26 bp, Artificial sequence
  single strand DNA oligonucleotide
cccttctacaagcaaatactcactcc

SEQ ID NO: 1431 - DNA, 25 bp, Artificial sequence
  single strand DNA oligonucleotide
gaccctctcatctcttattgaacca

SEQ ID NO: 1432 - DNA, 21 bp, Artificial sequence
  single strand DNA oligonucleotide
ggcgatccaacggagaagtag

SEQ ID NO: 1433 - DNA, 18 bp, Artificial sequence
  single strand DNA oligonucleotide
acatcggcagcacggagt

SEQ ID NO: 1434 - DNA, 22 bp, Artificial sequence
  single strand DNA oligonucleotide
ccggtgcataaggaaatacgag

SEQ ID NO: 1435 - DNA, 22 bp, Artificial sequence
  single strand DNA oligonucleotide
gacagattgaaaactgccccag

SEQ ID NO: 1436 - DNA, 20 bp, Artificial sequence
  single strand DNA oligonucleotide
gtcgatcatcgcattctcca

SEQ ID NO: 1437 - DNA, 21 bp, Artificial sequence
  single strand DNA oligonucleotide
tcctttcatcgtatcccccat

SEQ ID NO: 1438 - DNA, 24 bp, Artificial sequence
  single strand DNA oligonucleotide
cagatcttcttctctcagctccct

SEQ ID NO: 1439 - DNA, 20 bp, Artificial sequence
  single strand DNA oligonucleotide
gggctgaatcaacgtcgact

SEQ ID NO: 1440 - DNA, 20 bp, Artificial sequence
  single strand DNA oligonucleotide
gaagctgtgggtctcaaggg

SEQ ID NO: 1441 - DNA, 18 bp, Artificial sequence
  single strand DNA oligonucleotide
aggtcggcacgtactcgg

SEQ ID NO: 1442 - DNA, 23 bp, Artificial sequence
  single strand DNA oligonucleotide
tctacatccaggctctcgttagc

SEQ ID NO: 1443 - DNA, 27 bp, Artificial sequence
  single strand DNA oligonucleotide
ttcatcttcatcagtaagaccatcatc

SEQ ID NO: 1444 - DNA, 35 bp, Artificial sequence
  single strand DNA oligonucleotide
aacccgggaacaatgacaccacagatcaaaactca

SEQ ID NO: 1445 - DNA, 28 bp, Artificial sequence
  single strand DNA oligonucleotide
aggatatcatatgaatgctacggcaagc

SEQ ID NO: 1446 - DNA, 35 bp, Artificial sequence
  single strand DNA oligonucleotide
aaacccgggaacaatgaggtacgatcaggaagcgg

SEQ ID NO: 1447 - DNA, 28 bp, Artificial sequence
  single strand DNA oligonucleotide
ttgagctcgttcgctggaggtaacaatg

SEQ ID NO: 1448 - DNA, 35 bp, Artificial sequence
  single strand DNA oligonucleotide
aacccgggaacaatggatcaaaaagttagacagtt

SEQ ID NO: 1449 - DNA, 31 bp, Artificial sequence
  single strand DNA oligonucleotide
ttgatatccacaaaactctctagctcctgac

SEQ ID NO: 1450 - DNA, 37 bp, Artificial sequence
  single strand DNA oligonucleotide
aaacccgggaacaatggaggacaagaacaatgataag

SEQ ID NO: 1451 - DNA, 30 bp, Artificial sequence
  single strand DNA oligonucleotide
ttgagctcgggtctctttgtcatggagttc

SEQ ID NO: 1452 - DNA, 31 bp, Artificial sequence
  single strand DNA oligonucleotide
ctcccgggaacaatggctctcgtgacctcgg

SEQ ID NO: 1453 - DNA, 29 bp, Artificial sequence
  single strand DNA oligonucleotide
ttgagctccgcaacacagtttcatgacca

SEQ ID NO: 1454 - DNA, 29 bp, Artificial sequence
  single strand DNA oligonucleotide
ggtctagaaacaatggggaggggaaagat

SEQ ID NO: 1455 - DNA, 41 bp, Artificial sequence
  single strand DNA oligonucleotide
cgggatatcataagacgccagttttactcttattcatgggc

SEQ ID NO: 1456 - DNA, 29 bp, Artificial sequence
  single strand DNA oligonucleotide
ggtctagaaacaatggggaggggaaagat

SEQ ID NO: 1457 - DNA, 41 bp, Artificial sequence; identical to SEQ ID NO: 1455
  single strand DNA oligonucleotide

SEQ ID NO: 1458 - DNA, 29 bp, Artificial sequence
  single strand DNA oligonucleotide
aatctagaatggtggactttgttcgacgg

SEQ ID NO: 1459 - DNA, 26 bp, Artificial sequence
  single strand DNA oligonucleotide
ctgagctcacaggaggacatgccacc

SEQ ID NO: 1460 - DNA, 30 bp, Artificial sequence
  single strand DNA oligonucleotide
catctagaaacaatggcggactcgtcggcg

SEQ ID NO: 1461 - DNA, 29 bp, Artificial sequence
  single strand DNA oligonucleotide
ttgagctcgcagtgtgcaagagttccctc

SEQ ID NO: 1462 - DNA, 31 bp, Artificial sequence
  single strand DNA oligonucleotide
aatctagagtaataagccaacaaacaaaccg

SEQ ID NO: 1463 - DNA, 32 bp, Artificial sequence
  single strand DNA oligonucleotide
cagatatcctagcataccgaccctgaaaacac

SEQ ID NO: 1464 - DNA, 28 bp, Artificial sequence
  single strand DNA oligonucleotide
tatgtcgactcagatgaagaaggcggct

SEQ ID NO: 1465 - DNA, 35 bp, Artificial sequence
  single strand DNA oligonucleotide
gtcccgggtttattagatctctctaggagttttga

SEQ ID NO: 1466 - DNA, 25 bp, Artificial sequence
  single strand DNA oligonucleotide
ccactctgtggttcagactaggaac

SEQ ID NO: 1467 - DNA, 23 bp, Artificial sequence
  single strand DNA oligonucleotide
cattcaacagtatcatctggccc

SEQ ID NO: 1468 - DNA, 23 bp, Artificial sequence
  single strand DNA oligonucleotide
caggatggtctagtggagtggat

SEQ ID NO: 1469 - DNA, 26 bp, Artificial sequence
  single strand DNA oligonucleotide
gcagagtactggaacacaaggttatc

SEQ ID NO: 1470 - DNA, 25 bp, Artificial sequence
  single strand DNA oligonucleotide
cgtaagagagtgggacttactggat

SEQ ID NO: 1471 - DNA, 24 bp, Artificial sequence
  single strand DNA oligonucleotide
ccatgcctatcagagtacctgtga

SEQ ID NO: 1472 - DNA, 21 bp, Artificial sequence
  single strand DNA oligonucleotide
gtcctgcgtagacgagtcgaa

SEQ ID NO: 1473 - DNA, 25 bp, Artificial sequence
  single strand DNA oligonucleotide
agcttatgacaacaaatagaaccgc

SEQ ID NO: 1474 - DNA, 20 bp, Artificial sequence
  single strand DNA oligonucleotide
gccaccattgtactcgtccc

SEQ ID NO: 1475 - DNA, 19 bp, Artificial sequence
  single strand DNA oligonucleotide
gaagcccgtcagtccaagg

SEQ ID NO: 1476 - DNA, 22 bp, Artificial sequence
  single strand DNA oligonucleotide
ccagtgcatgtactaccaaggg

SEQ ID NO: 1477 - DNA, 18 bp, Artificial sequence
  single strand DNA oligonucleotide
ctaggccgactgatgccg

SEQ ID NO: 1478 - DNA, 24 bp, Artificial sequence
  single strand DNA oligonucleotide
acttacgccggagttatgaaagag

SEQ ID NO: 1479 - DNA, 25 bp, Artificial sequence
  single strand DNA oligonucleotide
aaaagtagcaaccatcgtagcaatc

SEQ ID NO: 1480 - DNA, 28 bp, Artificial sequence
  single strand DNA oligonucleotide
ctagaggctaaatacaaagacaagttcg

SEQ ID NO: 1481 - DNA, 20 bp, Artificial sequence
  single strand DNA oligonucleotide
gaacgcaccgtacatgatcg

SEQ ID NO: 1482 - DNA, 28 bp, Artificial sequence
  single strand DNA oligonucleotide
ttatctttatctactggtgcgttattgc

SEQ ID NO: 1483 - DNA, 21 bp, Artificial sequence
  single strand DNA oligonucleotide
acgtcgaatgaggcttacacg

SEQ ID NO: 1484 - DNA, 28 bp, Artificial sequence
  single strand DNA oligonucleotide
ccagcagaagtaatttagatgttgagtc

SEQ ID NO: 1485 - DNA, 18 bp, Artificial sequence
  single strand DNA oligonucleotide
ccaccaatgggcaattcc

SEQ ID NO: 1486 - DNA, 20 bp, Artificial sequence
  single strand DNA oligonucleotide
gataaggaggaatggcgcag

SEQ ID NO: 1487 - DNA, 26 bp, Artificial sequence
  single strand DNA oligonucleotide
gcatcctctacttgagagttgaacac

SEQ ID NO: 1488 - DNA, 21 bp, Artificial sequence
  single strand DNA oligonucleotide
caacttactccatgcgctggt

SEQ ID NO: 1489 - DNA, 24 bp, Artificial sequence
  single strand DNA oligonucleotide
ggctgttgttccttaagcctagag

SEQ ID NO: 1490 - DNA, 20 bp, Artificial sequence
  single strand DNA oligonucleotide
atgttgtttggccagcaggt

SEQ ID NO: 1491 - DNA, 21 bp, Artificial sequence
  single strand DNA oligonucleotide
aagtggaacagcgtgtgctct

SEQ ID NO: 1492 - DNA, 22 bp, Artificial sequence
  single strand DNA oligonucleotide
ccacaatcttaccgtgagacca

SEQ ID NO: 1493 - DNA, 26 bp, Artificial sequence
  single strand DNA oligonucleotide
gtacttagaggtagatgacccgaggt

SEQ ID NO: 1494 - DNA, 23 bp, Artificial sequence
  single strand DNA oligonucleotide
tgagagaatgtggaaggttgcat

SEQ ID NO: 1495 - DNA, 24 bp, Artificial sequence
  single strand DNA oligonucleotide
tcatggtagtcacagatcctggtc

SEQ ID NO: 1496 - DNA, 20 bp, Artificial sequence
  single strand DNA oligonucleotide
agtgttcgtcctcccagcac

SEQ ID NO: 1497 - DNA, 22 bp, Artificial sequence
  single strand DNA oligonucleotide
cctgccttttctggatgtcaac

SEQ ID NO: 1498 - DNA, 22 bp, Artificial sequence
  single strand DNA oligonucleotide
ttctcaacagggtgatgatgct

SEQ ID NO: 1499 - DNA, 28 bp, Artificial sequence
  single strand DNA oligonucleotide
gtctgaacagtcttggtaacagtctctt

SEQ ID NO: 1500 - DNA, 18 bp, Artificial sequence
  single strand DNA oligonucleotide
ttgtgttgggcgtgagca

SEQ ID NO: 1501 - DNA, 18 bp, Artificial sequence
  single strand DNA oligonucleotide
gggaggtggaagcaaggc

SEQ ID NO: 1502 - DNA, 19 bp, Artificial sequence
  single strand DNA oligonucleotide
aatggctttcgagggacca

SEQ ID NO: 1503 - DNA, 23 bp, Artificial sequence
  single strand DNA oligonucleotide
ggagaacaaagtagatctgccca

SEQ ID NO: 1504 - DNA, 23 bp, Artificial sequence
  single strand DNA oligonucleotide
ccttgacattgtttccaacgcta

SEQ ID NO: 1505 - DNA, 22 bp, Artificial sequence
  single strand DNA oligonucleotide
gacagtggtcatgagtccctca

SEQ ID NO: 1506 - DNA, 25 bp, Artificial sequence
  single strand DNA oligonucleotide
cttctgagcttttgtgatgtgatca

SEQ ID NO: 1507 - DNA, 21 bp, Artificial sequence
  single strand DNA oligonucleotide
ataagtttttcccgcagaccg

SEQ ID NO: 1508 - DNA, 21 bp, Artificial sequence
  single strand DNA oligonucleotide
agccaaagaccttcgctaacg

SEQ ID NO: 1509 - DNA, 25 bp, Artificial sequence
  single strand DNA oligonucleotide
ccagtcctagagaaagtgtatggga

SEQ ID NO: 1510 - DNA, 24 bp, Artificial sequence
  single strand DNA oligonucleotide
gtgtgggtcaataatcaggaagtg

SEQ ID NO: 1511 - DNA, 22 bp, Artificial sequence
  single strand DNA oligonucleotide
aataacatacggcgtgacatcg

SEQ ID NO: 1512 - DNA, 21 bp, Artificial sequence
  single strand DNA oligonucleotide
cgagaaagtatccatcatggc

SEQ ID NO: 1513 - DNA, 20 bp, Artificial sequence
  single strand DNA oligonucleotide
atgtcctgatagcggtccgc

SEQ ID NO: 1514 - DNA, 2322 bp, Arabidopsis thaliana
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

What is claimed is:

1. A method of increasing tolerance of a plant to an abiotic stress condition, comprising:
    (a) transforming a plant cell with a nucleic acid construct comprising a polynucleotide encoding a polypeptide comprising the amino acid sequence set forth in SEQ ID NO:1343,
    (b) regenerating a plant from said plant cell transformed with said nucleic acid construct, and
    (c) selecting said plant resultant of step (b) for an increased tolerance to an abiotic stress condition as compared to a non-transformed plant grown under the same growth conditions, wherein said abiotic stress condition is selected from the group consisting of drought, salinity stress and nitrogen deficiency,
    thereby increasing the tolerance of the plant to the abiotic stress condition.

2. A method of increasing fertilizer use efficiency and/or uptake of a plant comprising:
    (a) transforming a plant cell with a nucleic acid construct comprising a polynucleotide encoding a polypeptide comprising the amino acid sequence set forth in SEQ ID NO:1343,
    (b) regenerating a plant from said plant cell transformed with said nucleic acid construct, and
    (c) selecting said plant resultant of step (b) for an increased fertilizer use efficiency as compared to a non-transformed plant grown under same growth conditions,
    thereby increasing fertilizer use efficiency and/or uptake of the plant.

3. The method of claim 1, wherein said polynucleotide comprises the nucleotide sequence set forth in SEQ ID NO:1342.

4. The method of claim 1, wherein said abiotic stress comprises drought stress.

5. The method of claim 1, wherein said abiotic stress comprises salinity stress.

6. The method of claim 1, further comprising growing the plant under the abiotic stress condition.

7. The method of claim 2, wherein said fertilizer comprises nitrogen.

8. The method of claim 2, wherein said polynucleotide comprises the nucleotide sequence set forth in SEQ ID NO:1342.

9. The method of claim 1, wherein said selecting said plant is for an increased tolerance to salinity stress as compared to a non-transformed plant grown under the same growth conditions.

10. The method of claim 1, wherein said selecting said plant is for an increased tolerance to drought as compared to a non-transformed plant grown under the same growth conditions.

11. The method of claim 1, wherein said selecting said plant is for an increased tolerance to nitrogen deficiency as compared to a non-transformed plant grown under the same growth conditions.

* * * * *

UNITED STATES PATENT AND TRADEMARK OFFICE
CERTIFICATE OF CORRECTION

| | | |
|---|---|---|
| PATENT NO. | : 8,962,915 B2 | Page 1 of 1 |
| APPLICATION NO. | : 12/083978 | |
| DATED | : February 24, 2015 | |
| INVENTOR(S) | : Rodrigo Yelin et al. | |

It is certified that error appears in the above-identified patent and that said Letters Patent is hereby corrected as shown below:

Title page,

Item (63) Related U.S. Application Data, line 1, "11/626,411"

should be changed to -- 11/629,411 --

Signed and Sealed this
Eighth Day of September, 2015

Michelle K. Lee
*Director of the United States Patent and Trademark Office*